(12) United States Patent
Boucher et al.

(10) Patent No.: US 12,234,464 B2
(45) Date of Patent: Feb. 25, 2025

(54) BIOSYNTHESIS OF MOGROSIDES

(71) Applicant: Ginkgo Bioworks, Inc., Boston, MA (US)

(72) Inventors: Jeffrey Ian Boucher, Allston, MA (US); Nicholas Flores, Cambridge, MA (US); Jaide Jensen, Cambridge, MA (US); Dayal Saran, Melrose, MA (US); Jue Wang, Seattle, WA (US)

(73) Assignee: Ginkgo Bioworks, Inc., Boston, MA (US)

( * ) Notice: Subject to any disclaimer, the term of this patent is extended or adjusted under 35 U.S.C. 154(b) by 829 days.

(21) Appl. No.: 17/292,266

(22) PCT Filed: Nov. 9, 2019

(86) PCT No.: PCT/US2019/060652
§ 371 (c)(1),
(2) Date: May 7, 2021

(87) PCT Pub. No.: WO2020/097588
PCT Pub. Date: May 14, 2020

(65) Prior Publication Data
US 2021/0403921 A1 Dec. 30, 2021

Related U.S. Application Data

(60) Provisional application No. 62/758,474, filed on Nov. 9, 2018.

(51) Int. Cl.
*C12N 15/52* (2006.01)
*C12N 9/90* (2006.01)
*C12N 15/70* (2006.01)
*C12N 15/81* (2006.01)
*C12P 19/60* (2006.01)

(52) U.S. Cl.
CPC .............. *C12N 15/52* (2013.01); *C12N 9/90* (2013.01); *C12N 15/70* (2013.01); *C12N 15/81* (2013.01); *C12P 19/60* (2013.01); *C12Y 504/99033* (2013.01)

(58) Field of Classification Search
CPC .......... C12N 15/52; C12N 9/90; C12N 15/70; C12N 15/81; C12N 9/1051; C12N 9/14; C12N 9/0042; C12N 9/0071; C12P 19/60; C12P 19/18; C12P 33/00; C12P 33/12; C12Y 504/99033; C12Y 204/01017; C12Y 114/14; C12Y 303/02; C12Y 106/02004; A23L 2/60; A23L 27/36
See application file for complete search history.

(56) References Cited

U.S. PATENT DOCUMENTS

| | | | |
|---|---|---|---|
| 5,821,097 A | 10/1998 | Baltz et al. |
| 5,821,098 A | 10/1998 | Baltz et al. |
| 5,821,099 A | 10/1998 | Baltz et al. |
| 5,821,100 A | 10/1998 | Baltz et al. |
| 5,871,983 A | 2/1999 | Baltz et al. |
| 5,932,464 A | 8/1999 | Baltz et al. |
| 6,025,173 A | 2/2000 | Baltz et al. |
| 6,025,174 A | 2/2000 | Baltz et al. |
| 6,027,928 A | 2/2000 | Baltz et al. |
| 6,087,143 A | 7/2000 | Baltz et al. |
| 6,143,542 A | 11/2000 | Wisnewski et al. |
| 6,150,415 A | 11/2000 | Hammock et al. |
| 6,153,397 A | 11/2000 | Wisnewski et al. |
| 6,232,102 B1 | 5/2001 | Baltz et al. |
| 6,498,239 B1 | 12/2002 | Baltrusch et al. |
| 6,566,100 B2 | 5/2003 | Baltz et al. |
| 6,566,108 B1 | 5/2003 | Wolf et al. |
| 6,770,747 B1 | 8/2004 | Sakakibara et al. |
| 6,809,371 B2 | 10/2004 | Sugiyama |
| 6,828,115 B1 | 12/2004 | Zocher et al. |
| 6,943,001 B2 | 9/2005 | Zhao et al. |
| 6,979,733 B2 | 12/2005 | Zhao et al. |
| 7,060,477 B2 | 6/2006 | Arand et al. |
| 7,214,786 B2 | 5/2007 | Kovalic et al. |
| 7,335,504 B2 | 2/2008 | Haupts et al. |
| 7,351,573 B2 | 4/2008 | Dunn-Coleman et al. |
| 7,439,322 B2 | 10/2008 | Baltz et al. |
| 7,504,490 B1 | 3/2009 | Weinstock et al. |
| 7,569,389 B2 | 8/2009 | Feldmann et al. |

(Continued)

FOREIGN PATENT DOCUMENTS

| | | |
|---|---|---|
| AU | 2019304965 A1 | 2/2021 |
| CA | 2353910 A1 | 6/2000 |

(Continued)

OTHER PUBLICATIONS

Qiao, J., Luo, Z., Gu, Z., Zhang, Y., Zhang, X., & Ma, X. (2019). Identification of a novel specific cucurbitadienol synthase allele in Siraitia grosvenorii correlates with high catalytic efficiency. Molecules, 24(3), 627. (Year: 2019).*
Cleveland Clinic. (May 12, 2021). Enzymes. Cleveland Clinic; Cleveland Clinic. https://my.clevelandclinic.org/health/articles/21532-enzymes (Year: 2021).*
Wang, J., Guo, Y., Yin, X., Wang, X., Qi, X., & Xue, Z. (2022). Diverse triterpene skeletons are derived from the expansion and divergent evolution of 2, 3-oxidosqualene cyclases in plants. Critical Reviews in Biochemistry and Molecular Biology, 57(2), 113-132. (Year: 2022).*
National Center for Biotechnology Information (2024). PubChem Compound Summary for CID 5366020, 2,3-Oxidosqualene. Retrieved May 8, 2024 from https://pubchem.ncbi.nlm.nih.gov/compound/2_3-Oxidosqualene. (Year: 2024).*

(Continued)

*Primary Examiner* — Sarah Alawadi
*Assistant Examiner* — Kimberly C. Breen
(74) *Attorney, Agent, or Firm* — Wolf, Greenfield & Sacks, P.C.

(57) ABSTRACT

Provided herein are enzymes (e.g., cucurbitadienol synthases (CDS), UDP-glycosyltransferases (UGT), C11 hydroxylases, epoxide hydrolases (EPH), squalene epoxidases, and/or cytochrome P450 reductases), host cells expressing the enzymes, and methods of producing mogrol precursors, mogrol, and/or mogrosides using such host cells.

19 Claims, 15 Drawing Sheets

Specification includes a Sequence Listing.

(56) References Cited

U.S. PATENT DOCUMENTS

| | | |
|---|---|---|
| 7,630,836 B2 | 12/2009 | Omura et al. |
| 7,662,583 B2 | 2/2010 | Lim et al. |
| 7,834,146 B2 | 11/2010 | Kovalic et al. |
| 7,867,704 B2 | 1/2011 | Kapur et al. |
| 7,989,676 B2 | 8/2011 | Troukhan et al. |
| 8,003,776 B2 | 8/2011 | James et al. |
| 8,030,048 B2 | 10/2011 | Kim et al. |
| 8,093,028 B2 | 1/2012 | Thorson et al. |
| 8,106,174 B2 | 1/2012 | Kovalic et al. |
| 8,119,385 B2 | 2/2012 | Mathur et al. |
| 8,163,980 B2 | 4/2012 | Ro et al. |
| 8,299,318 B2 | 10/2012 | Brover et al. |
| 8,362,325 B2 | 1/2013 | Troukhan et al. |
| 8,399,650 B2 | 3/2013 | James et al. |
| 8,481,286 B2 | 7/2013 | Julien et al. |
| 8,609,371 B2 | 12/2013 | Julien et al. |
| 8,637,287 B2 | 1/2014 | Thorson et al. |
| 8,753,842 B2 | 6/2014 | Julien et al. |
| 8,759,632 B2 | 6/2014 | Ro et al. |
| 8,828,684 B2 | 9/2014 | Keasling et al. |
| 8,962,800 B2 | 2/2015 | Mathur et al. |
| 9,012,723 B2 | 4/2015 | Guo et al. |
| 9,150,840 B2 | 10/2015 | Kamal et al. |
| 9,303,252 B2 | 4/2016 | Amick et al. |
| 9,309,573 B2 | 4/2016 | Brover et al. |
| 9,388,444 B2 | 7/2016 | Solaiman et al. |
| 9,562,251 B2 | 2/2017 | Kishore et al. |
| 9,567,619 B2 | 2/2017 | Mao et al. |
| 9,603,373 B2 | 3/2017 | Markosyan |
| 9,611,498 B2 | 4/2017 | Wang et al. |
| 9,631,215 B2 | 4/2017 | Houghton-Larsen et al. |
| 9,643,990 B2 | 5/2017 | Mao et al. |
| 9,701,726 B2 | 7/2017 | Troukhan et al. |
| 9,714,418 B2 | 7/2017 | Amick et al. |
| 9,719,064 B2 | 8/2017 | Selber et al. |
| 9,738,913 B2 | 8/2017 | Beardslee et al. |
| 9,745,602 B2 | 8/2017 | Daviet et al. |
| 9,752,174 B2 | 9/2017 | Markosyan et al. |
| 9,783,566 B2 | 10/2017 | Mao et al. |
| 9,809,829 B2 | 11/2017 | Keasling et al. |
| 9,822,374 B2 | 11/2017 | Katz et al. |
| 9,834,782 B2 | 12/2017 | Poraty-Gavra et al. |
| 9,920,349 B2 | 3/2018 | Liu et al. |
| 9,932,619 B2 | 4/2018 | Liu et al. |
| 9,976,167 B2 | 5/2018 | Zhou et al. |
| 10,011,859 B2 | 7/2018 | Liu et al. |
| 10,017,804 B2 | 7/2018 | Simon et al. |
| 10,150,971 B2 | 12/2018 | Brover et al. |
| 10,364,450 B2 | 7/2019 | Olsson et al. |
| 10,392,644 B2 | 8/2019 | Kishore et al. |
| 10,392,673 B2 | 8/2019 | Kino et al. |
| 10,407,706 B2 | 9/2019 | Ono et al. |
| 10,465,222 B2 | 11/2019 | Liu et al. |
| 10,633,685 B2 | 4/2020 | Houghton-Larsen et al. |
| 10,662,442 B2 | 5/2020 | Kumaran et al. |
| 10,662,458 B2 | 5/2020 | Liu et al. |
| 10,689,682 B2 | 6/2020 | Ono et al. |
| 10,982,249 B2 | 4/2021 | Douchin et al. |
| 11,060,124 B2 | 7/2021 | Patron et al. |
| 11,091,787 B2 | 8/2021 | Houghton-Larsen et al. |
| 11,168,309 B2 | 11/2021 | Donald et al. |
| 11,180,789 B2 | 11/2021 | Lo et al. |
| 11,230,724 B2 | 1/2022 | Kumaran et al. |
| 11,248,248 B2 | 2/2022 | Houghton-Larsen |
| 2002/0155567 A1 | 10/2002 | Baltz et al. |
| 2003/0153042 A1 | 8/2003 | Arnold et al. |
| 2003/0215915 A1 | 11/2003 | Wolf et al. |
| 2004/0018964 A1 | 1/2004 | Baltz et al. |
| 2004/0031072 A1 | 2/2004 | La Rosa et al. |
| 2004/0034888 A1 | 2/2004 | Liu et al. |
| 2004/0123343 A1 | 6/2004 | La Rosa et al. |
| 2004/0132055 A1 | 7/2004 | Katz et al. |
| 2004/0172684 A1 | 9/2004 | Kovalic et al. |
| 2004/0214272 A1 | 10/2004 | La Rosa et al. |
| 2004/0241826 A1 | 12/2004 | James et al. |
| 2005/0002897 A1 | 1/2005 | Haupts et al. |
| 2005/0175581 A1 | 8/2005 | Haupts et al. |
| 2006/0048240 A1 | 3/2006 | Alexandrov et al. |
| 2006/0107345 A1 | 5/2006 | Alexandrov et al. |
| 2006/0123505 A1 | 6/2006 | Kikuchi et al. |
| 2006/0150283 A1 | 7/2006 | Alexandrov et al. |
| 2006/0183202 A1 | 8/2006 | Poppenberger et al. |
| 2007/0011783 A1 | 1/2007 | Liu et al. |
| 2007/0042383 A1 | 2/2007 | Kapur et al. |
| 2007/0044171 A1 | 2/2007 | Kovalic et al. |
| 2007/0061916 A1 | 3/2007 | Kovalic et al. |
| 2007/0107083 A1 | 5/2007 | Poppenberger et al. |
| 2007/0124832 A1 | 5/2007 | Lim et al. |
| 2007/0214517 A1 | 9/2007 | Alexandrov et al. |
| 2007/0271633 A9 | 11/2007 | Kovalic et al. |
| 2007/0277269 A1 | 11/2007 | Alexandrov et al. |
| 2007/0283460 A9 | 12/2007 | Liu et al. |
| 2008/0072340 A1 | 3/2008 | Troukhan et al. |
| 2008/0145892 A1 | 6/2008 | Donadio et al. |
| 2008/0148432 A1 | 6/2008 | Abad |
| 2008/0293099 A1 | 11/2008 | Ono et al. |
| 2009/0082296 A1 | 3/2009 | James et al. |
| 2009/0087878 A9 | 4/2009 | La Rosa et al. |
| 2009/0094717 A1 | 4/2009 | Troukhan et al. |
| 2009/0144848 A1 | 6/2009 | Kovalic et al. |
| 2009/0181854 A1 | 7/2009 | Thorson et al. |
| 2009/0208440 A1 | 8/2009 | Haupts et al. |
| 2009/0208474 A1 | 8/2009 | Haupts et al. |
| 2009/0217406 A1 | 8/2009 | Puzio et al. |
| 2010/0017904 A1 | 1/2010 | Abad et al. |
| 2010/0037352 A1 | 2/2010 | Alexandrov et al. |
| 2010/0037355 A1 | 2/2010 | Alexandrov et al. |
| 2010/0064387 A1 | 3/2010 | Dixon et al. |
| 2010/0083407 A1 | 4/2010 | Feldmann et al. |
| 2010/0143915 A1 | 6/2010 | Ronald et al. |
| 2010/0297722 A1 | 11/2010 | Anterola et al. |
| 2011/0131679 A2 | 6/2011 | La Rosa et al. |
| 2011/0162107 A1 | 6/2011 | Inze et al. |
| 2011/0167514 A1 | 7/2011 | Brover et al. |
| 2011/0179531 A1 | 7/2011 | Kovalic et al. |
| 2011/0182862 A1 | 7/2011 | Green et al. |
| 2011/0209246 A1 | 8/2011 | Kovalic et al. |
| 2011/0214199 A1 | 9/2011 | Coffin |
| 2011/0214205 A1 | 9/2011 | Dietrich et al. |
| 2011/0214206 A1 | 9/2011 | La Rosa et al. |
| 2011/0277178 A1 | 11/2011 | Liu et al. |
| 2011/0277190 A1 | 11/2011 | Abad |
| 2011/0306074 A1 | 12/2011 | Thorson et al. |
| 2012/0011598 A1 | 1/2012 | Troukhan et al. |
| 2012/0017292 A1 | 1/2012 | Kovalic et al. |
| 2012/0017338 A1 | 1/2012 | Wu et al. |
| 2012/0034689 A1 | 2/2012 | James et al. |
| 2012/0096584 A1 | 4/2012 | Alexandrov et al. |
| 2012/0096599 A1 | 4/2012 | Kovalic et al. |
| 2012/0159672 A1 | 6/2012 | Alexandrov et al. |
| 2012/0216318 A1 | 8/2012 | La Rosa et al. |
| 2012/0246748 A1 | 9/2012 | Guo et al. |
| 2013/0004979 A1 | 1/2013 | Thorson et al. |
| 2013/0031668 A1 | 1/2013 | Brover et al. |
| 2013/0097737 A1 | 4/2013 | Kovalic et al. |
| 2013/0117886 A1 | 5/2013 | Troukhan et al. |
| 2013/0131845 A1 | 5/2013 | Guilleminot |
| 2013/0167263 A1 | 6/2013 | Liu et al. |
| 2013/0171328 A1 | 7/2013 | Kishore et al. |
| 2013/0185831 A1 | 7/2013 | Kovalic et al. |
| 2013/0302855 A1 | 11/2013 | Selber et al. |
| 2013/0305398 A1 | 11/2013 | Coffin |
| 2013/0326723 A1 | 12/2013 | La Rosa et al. |
| 2013/0333061 A1 | 12/2013 | Wu et al. |
| 2013/0333068 A1 | 12/2013 | Coffin |
| 2013/0337508 A1 | 12/2013 | Fujdala et al. |
| 2013/0338348 A1 | 12/2013 | Rommens et al. |
| 2014/0115737 A1 | 4/2014 | Abad |
| 2014/0130203 A1 | 5/2014 | La Rosa et al. |
| 2014/0165234 A1 | 6/2014 | Dietrich et al. |
| 2014/0228586 A1 | 8/2014 | Beardslee et al. |
| 2014/0248668 A1 | 9/2014 | Raghavan et al. |
| 2014/0249301 A1 | 9/2014 | Steffens |
| 2014/0259218 A1 | 9/2014 | Kovalic et al. |

(56) References Cited

U.S. PATENT DOCUMENTS

| | | |
|---|---|---|
| 2014/0308698 A1 | 10/2014 | Liu et al. |
| 2014/0325713 A1 | 10/2014 | Kovalic et al. |
| 2014/0329281 A1 | 11/2014 | Houghton-Larsen et al. |
| 2014/0357588 A1 | 12/2014 | Markosyan et al. |
| 2014/0359836 A1 | 12/2014 | Wu et al. |
| 2015/0031868 A1 | 1/2015 | Lehmann et al. |
| 2015/0064743 A1 | 3/2015 | Liu et al. |
| 2015/0113680 A1 | 4/2015 | Kovalic et al. |
| 2015/0128306 A1 | 5/2015 | Ono |
| 2015/0140132 A1 | 5/2015 | Ono et al. |
| 2015/0143581 A1 | 5/2015 | Liu et al. |
| 2015/0152146 A1 | 6/2015 | Kovalic et al. |
| 2015/0159188 A1 | 6/2015 | Ono et al. |
| 2015/0167015 A1 | 6/2015 | Poraty-Gavra et al. |
| 2015/0191739 A1 | 7/2015 | La Rosa et al. |
| 2015/0197763 A1 | 7/2015 | La Rosa et al. |
| 2015/0197765 A1 | 7/2015 | Guo et al. |
| 2015/0218533 A1 | 8/2015 | Ono |
| 2015/0218588 A1 | 8/2015 | Schalk et al. |
| 2015/0252401 A1 | 9/2015 | Wang et al. |
| 2015/0267236 A1 | 9/2015 | Solaiman et al. |
| 2015/0307890 A1 | 10/2015 | Wu et al. |
| 2015/0315605 A1 | 11/2015 | Li et al. |
| 2015/0322473 A1* | 11/2015 | Liu ..................... C12P 19/56 |
| 2015/0361476 A1 | 12/2015 | Simon et al. |
| 2015/0376629 A1 | 12/2015 | Punt et al. |
| 2016/0010133 A1 | 1/2016 | Park et al. |
| 2016/0095338 A1 | 4/2016 | Mao et al. |
| 2016/0097063 A1 | 4/2016 | Li et al. |
| 2016/0097070 A1 | 4/2016 | Mao et al. |
| 2016/0097071 A1 | 4/2016 | Mao et al. |
| 2016/0097072 A1 | 4/2016 | Mao et al. |
| 2016/0102331 A1 | 4/2016 | Boer et al. |
| 2016/0115515 A1 | 4/2016 | Zhou et al. |
| 2016/0122783 A1 | 5/2016 | Coffin |
| 2016/0153017 A1 | 6/2016 | Van Der Hoeven et al. |
| 2016/0153018 A1 | 6/2016 | Mao et al. |
| 2016/0160257 A1 | 6/2016 | Broers et al. |
| 2016/0177360 A1 | 6/2016 | Boer et al. |
| 2016/0185813 A1 | 6/2016 | Galaev |
| 2016/0186225 A1 | 6/2016 | Mikkelsen et al. |
| 2016/0198748 A1 | 7/2016 | Prakash et al. |
| 2016/0213039 A1 | 7/2016 | Kumar et al. |
| 2016/0215306 A1 | 7/2016 | Baerends et al. |
| 2016/0244777 A1 | 8/2016 | Coffin |
| 2016/0251635 A1 | 9/2016 | Mao et al. |
| 2016/0264984 A1 | 9/2016 | La Rosa et al. |
| 2016/0272990 A1 | 9/2016 | Kovalic et al. |
| 2016/0298145 A1 | 10/2016 | Laplaza et al. |
| 2016/0298159 A1 | 10/2016 | Tao et al. |
| 2016/0319294 A1 | 11/2016 | Kovalic et al. |
| 2016/0319295 A1 | 11/2016 | Brover et al. |
| 2016/0319317 A1 | 11/2016 | Ono |
| 2016/0326206 A1 | 11/2016 | Mao et al. |
| 2017/0081691 A1 | 3/2017 | Mao et al. |
| 2017/0114356 A1 | 4/2017 | Li et al. |
| 2017/0119032 A1 | 5/2017 | Patron et al. |
| 2017/0130233 A1 | 5/2017 | Lang et al. |
| 2017/0137846 A1 | 5/2017 | Atsumi et al. |
| 2017/0145396 A1 | 5/2017 | Bott et al. |
| 2017/0152521 A9 | 6/2017 | Wu et al. |
| 2017/0181452 A1 | 6/2017 | Mao et al. |
| 2017/0196248 A1 | 7/2017 | Mao et al. |
| 2017/0204380 A1 | 7/2017 | Schwab |
| 2017/0211113 A1 | 7/2017 | Tao et al. |
| 2017/0218418 A1 | 8/2017 | Douchin et al. |
| 2017/0218419 A1 | 8/2017 | Kishore et al. |
| 2017/0218420 A1 | 8/2017 | Mao et al. |
| 2017/0218421 A1 | 8/2017 | Mao et al. |
| 2017/0240942 A1 | 8/2017 | Lunde Robertson et al. |
| 2017/0247735 A1* | 8/2017 | Houghton-Larsen ... C12P 33/00 |
| 2017/0268018 A1 | 9/2017 | Dietrich et al. |
| 2017/0275666 A1 | 9/2017 | Prakash et al. |
| 2017/0283844 A1 | 10/2017 | Itkin et al. |
| 2017/0298404 A1 | 10/2017 | Mao et al. |
| 2017/0303565 A1 | 10/2017 | Markosyan et al. |
| 2017/0306376 A1 | 10/2017 | Raghavan et al. |
| 2017/0306377 A1 | 10/2017 | Van Den Berg et al. |
| 2017/0314037 A1 | 11/2017 | Kovalic et al. |
| 2017/0321238 A1 | 11/2017 | Houghton-Larsen et al. |
| 2017/0332673 A1 | 11/2017 | Philippe et al. |
| 2017/0356059 A1 | 12/2017 | Kino et al. |
| 2017/0369922 A1 | 12/2017 | Olsson et al. |
| 2018/0080055 A1 | 3/2018 | Mao et al. |
| 2018/0142216 A1 | 5/2018 | Naesby et al. |
| 2018/0230505 A1 | 8/2018 | Boer et al. |
| 2018/0237819 A1 | 8/2018 | Liu et al. |
| 2018/0245103 A1 | 8/2018 | Kumaran et al. |
| 2018/0251806 A1 | 9/2018 | Liu et al. |
| 2018/0258449 A1 | 9/2018 | McBride et al. |
| 2018/0282776 A1 | 10/2018 | Douchin et al. |
| 2018/0327723 A1 | 11/2018 | Saran et al. |
| 2018/0346953 A1 | 12/2018 | Liu et al. |
| 2018/0371517 A1 | 12/2018 | Simon et al. |
| 2019/0071705 A1 | 3/2019 | Parton et al. |
| 2019/0127772 A1 | 5/2019 | Vroom et al. |
| 2019/0203245 A1 | 7/2019 | Douchin et al. |
| 2020/0140838 A1 | 5/2020 | Schoenert et al. |
| 2020/0165652 A1 | 5/2020 | Houghton-Larsen |
| 2020/0291442 A1 | 9/2020 | Douchin et al. |
| 2020/0325517 A1 | 10/2020 | Houghton-Larsen et al. |
| 2020/0377865 A1 | 12/2020 | Donald et al. |
| 2021/0032669 A1 | 2/2021 | Philippe et al. |
| 2021/0095322 A1 | 4/2021 | Markosyan et al. |
| 2021/0126960 A1 | 4/2021 | Brodersen et al. |
| 2021/0207078 A1 | 7/2021 | Love et al. |
| 2021/0324439 A1 | 10/2021 | Patron et al. |
| 2021/0355458 A1 | 11/2021 | Zhao et al. |
| 2021/0355517 A1 | 11/2021 | Pauthenier et al. |
| 2022/0073960 A1 | 3/2022 | Kishore et al. |
| 2022/0081699 A1 | 3/2022 | Anderson et al. |
| 2022/0162658 A1 | 5/2022 | Kumaran et al. |
| 2022/0170063 A1 | 6/2022 | Itkin et al. |
| 2022/0228186 A1 | 7/2022 | Zanghellini et al. |
| 2022/0378072 A1 | 12/2022 | Boucher et al. |
| 2023/0042171 A1 | 2/2023 | Goettge et al. |
| 2023/0174993 A1 | 6/2023 | Boucher et al. |
| 2024/0158451 A1 | 5/2024 | Becker et al. |
| 2024/0200114 A1 | 6/2024 | Beaudoin et al. |
| 2024/0218403 A1 | 7/2024 | Beaudoin et al. |

FOREIGN PATENT DOCUMENTS

| | | | |
|---|---|---|---|
| CA | 2853677 A1 | 5/2013 | |
| CA | 2972739 A1 | 3/2016 | |
| CA | 2963300 A1 | 4/2016 | |
| CA | 2972939 A1 | 7/2016 | |
| CA | 3027180 A1 | 12/2017 | |
| CA | 3106633 A1 | 1/2020 | |
| CA | 3118467 A1 | 5/2020 | |
| CA | 3118675 A1 | 5/2020 | |
| CN | 1531590 A | 9/2004 | |
| CN | 104017797 A * | 9/2014 | ............... C12N 9/90 |
| CN | 105018438 A | 11/2015 | |
| CN | 104017798 B | 8/2016 | |
| CN | 107109377 A | 8/2017 | |
| CN | 107466320 A | 12/2017 | |
| CN | 112063678 A | 12/2020 | |
| CN | 113481275 A | 10/2021 | |
| CN | 113584110 A | 11/2021 | |
| CN | 113755355 A | 12/2021 | |
| CN | 114410492 A | 4/2022 | |
| EP | 0914446 A2 | 5/1999 | |
| EP | 0983367 A1 | 3/2000 | |
| EP | 1025213 A1 | 8/2000 | |
| EP | 1173585 A1 | 1/2002 | |
| EP | 1196590 A1 | 4/2002 | |
| EP | 1258494 A1 | 11/2002 | |
| EP | 1338608 A2 | 8/2003 | |
| EP | 1460085 A1 | 9/2004 | |
| EP | 1852508 A2 | 11/2007 | |
| EP | 1887081 A2 | 2/2008 | |
| EP | 1989302 A2 | 11/2008 | |
| EP | 2001999 A1 | 12/2008 | |

(56) References Cited

FOREIGN PATENT DOCUMENTS

| | | |
|---|---|---|
| EP | 2193140 A2 | 6/2010 |
| EP | 2326707 A2 | 6/2011 |
| EP | 2575432 A1 | 4/2013 |
| EP | 2742131 A2 | 6/2014 |
| EP | 2748303 A1 | 7/2014 |
| EP | 2783009 A1 | 10/2014 |
| EP | 2929043 A1 | 10/2015 |
| EP | 3004128 A1 | 4/2016 |
| EP | 3009508 A1 | 4/2016 |
| EP | 3052638 A1 | 8/2016 |
| EP | 3126492 A2 | 2/2017 |
| EP | 3183349 A1 | 6/2017 |
| EP | 3472308 A1 | 6/2017 |
| EP | 3191584 A1 | 7/2017 |
| EP | 3208342 A1 | 8/2017 |
| EP | 3615679 A2 | 3/2020 |
| EP | 3625334 A1 | 3/2020 |
| EP | 3638804 A1 | 4/2020 |
| EP | 3759230 A2 | 1/2021 |
| EP | 3764810 A1 | 1/2021 |
| EP | 3824093 A2 | 5/2021 |
| EP | 3860364 A1 | 8/2021 |
| EP | 3861101 A1 | 8/2021 |
| JP | 2002-541764 A | 12/2002 |
| JP | 2003-284572 A | 10/2003 |
| JP | 2006-527738 A | 6/2004 |
| JP | 2004-305049 A | 11/2004 |
| JP | 2005-508613 A | 4/2005 |
| JP | 2005-176602 A | 7/2005 |
| JP | 2005-185101 A | 7/2005 |
| JP | 2006-514551 A | 5/2006 |
| JP | 2006-516885 A | 7/2006 |
| JP | 2006-527590 A | 12/2006 |
| JP | 2007-504836 A | 3/2007 |
| JP | 2013-158297 A | 8/2013 |
| JP | 2013-533736 A | 8/2013 |
| JP | 2013-535206 A | 9/2013 |
| JP | 2014-524246 A | 9/2014 |
| JP | 2014-524247 A | 9/2014 |
| JP | 2014-533518 A | 12/2014 |
| JP | 2015-536157 A | 12/2015 |
| JP | 2016-501040 A | 1/2016 |
| JP | 2016-504023 A | 2/2016 |
| JP | 2016-506739 A | 3/2016 |
| JP | 2016-506743 A | 3/2016 |
| JP | 2016-508378 A | 3/2016 |
| JP | 2017-500056 A | 1/2017 |
| JP | 2017-504341 A | 2/2017 |
| JP | 2017-148050 A | 8/2017 |
| JP | 2017-529860 A | 10/2017 |
| JP | 6698028 B2 | 5/2020 |
| KR | 1020070105563 A | 10/2007 |
| KR | 20130002684 U | 5/2013 |
| KR | 101559478 B1 | 10/2015 |
| KR | 101791597 B1 | 10/2017 |
| KR | 2019-0017045 A | 2/2019 |
| KR | 20210066790 A | 6/2021 |
| KR | 2021-0090218 A | 7/2021 |
| KR | 20210089717 A | 7/2021 |
| WO | WO 94/29434 A1 | 12/1994 |
| WO | WO 2000/066716 A2 | 11/2000 |
| WO | WO 2002/010210 A2 | 2/2002 |
| WO | WO 02/086090 A2 | 10/2002 |
| WO | WO 2003/072602 A2 | 9/2003 |
| WO | WO 2004/035798 A2 | 4/2004 |
| WO | WO 2004/113521 A1 | 12/2004 |
| WO | WO 2004/113522 A1 | 12/2004 |
| WO | WO 2005/080576 A1 | 9/2005 |
| WO | WO 2006/003456 A2 | 1/2006 |
| WO | WO 2006/014837 A1 | 2/2006 |
| WO | WO 2006/067198 A2 | 6/2006 |
| WO | WO 2008/034648 A1 | 3/2008 |
| WO | WO 2008/062165 A2 | 5/2008 |
| WO | WO 2009/015268 A2 | 1/2009 |
| WO | WO 2009/093007 A2 | 7/2009 |
| WO | WO 2010/019696 A2 | 2/2010 |
| WO | WO 2011/153378 A1 | 12/2011 |
| WO | WO 2013/021261 A2 | 2/2013 |
| WO | WO 2013/076577 A1 | 5/2013 |
| WO | WO 2013/137487 A1 | 9/2013 |
| WO | WO 2014/051215 A1 | 4/2014 |
| WO | WO 2014/067007 A1 | 5/2014 |
| WO | WO 2014/081884 A1 | 5/2014 |
| WO | WO 2014/086842 A1 | 6/2014 |
| WO | WO 2014/102774 A1 | 7/2014 |
| WO | WO 2014/191524 A1 | 12/2014 |
| WO | WO 2015/028324 A2 | 3/2015 |
| WO | WO 2015/048332 A2 | 4/2015 |
| WO | WO 2015/113231 A1 | 8/2015 |
| WO | WO 2015/197841 A1 | 12/2015 |
| WO | WO 2016/029153 A1 | 2/2016 |
| WO | WO 2016/038617 A1 | 3/2016 |
| WO | WO 2016/050890 A2 | 4/2016 |
| WO | WO 2016/060276 A1 | 4/2016 |
| WO | WO 2016/071505 A1 | 5/2016 |
| WO | WO 2016/120486 A1 | 8/2016 |
| WO | WO 2016/151046 A1 | 9/2016 |
| WO | WO 2016/168413 A1 | 10/2016 |
| WO | WO 2017/000366 A1 | 1/2017 |
| WO | WO 2017/025362 A1 | 2/2017 |
| WO | WO 2017/025648 A1 | 2/2017 |
| WO | WO 2017/025649 A1 | 2/2017 |
| WO | WO 2017/031424 A1 | 2/2017 |
| WO | WO 2017/053574 A1 | 3/2017 |
| WO | WO 2017/066845 A1 | 4/2017 |
| WO | WO 2017/075257 A2 | 5/2017 |
| WO | WO 2017/085028 A1 | 5/2017 |
| WO | WO 2017/098017 A1 | 6/2017 |
| WO | WO 2017/153538 A1 | 9/2017 |
| WO | WO 2017/178632 A1 | 10/2017 |
| WO | WO 2017/198681 A1 | 11/2017 |
| WO | WO 2017/198682 A1 | 11/2017 |
| WO | WO 2017/207484 A1 | 12/2017 |
| WO | WO 2017/218324 A1 | 12/2017 |
| WO | WO 2018/144996 A1 | 8/2018 |
| WO | WO 2018/083338 A1 | 11/2018 |
| WO | WO 2018/204483 A2 | 11/2018 |
| WO | WO 2018/211032 A1 | 11/2018 |
| WO | WO 2018/229283 A1 | 12/2018 |
| WO | WO 2019/113387 A1 | 6/2019 |
| WO | WO 2019/169027 A2 | 9/2019 |
| WO | WO 2019/211230 A1 | 11/2019 |
| WO | WO 2020/018506 A2 | 1/2020 |
| WO | WO 2020/051488 A1 | 3/2020 |
| WO | WO 2020/081739 A1 | 4/2020 |
| WO | WO 2020/096905 A1 | 5/2020 |
| WO | WO 2020/096907 A1 | 5/2020 |
| WO | WO 2020/097588 A1 | 5/2020 |
| WO | WO 2020/237226 A1 | 11/2020 |
| WO | WO 2020/264179 A1 | 12/2020 |
| WO | WO 2021/202513 A1 | 1/2021 |
| WO | WO 2021/081327 A1 | 4/2021 |
| WO | WO 2021/126960 A1 | 6/2021 |
| WO | WO 2021/174092 A1 | 9/2021 |
| WO | WO 2021/188456 A1 | 9/2021 |
| WO | WO 2021/188457 A1 | 9/2021 |
| WO | WO 2021/188703 A1 | 9/2021 |
| WO | WO 2021/231728 A1 | 11/2021 |
| WO | WO 2022/115527 A1 | 6/2022 |
| WO | WO 2022/133314 A1 | 6/2022 |
| WO | WO 2022/192688 A1 | 9/2022 |
| WO | WO 2022/212917 A1 | 10/2022 |
| WO | WO 2022/212924 A1 | 10/2022 |

OTHER PUBLICATIONS

Translation of Ma CN104017797 retrieved from Espacenet on Oct. 1, 2024 from https://worldwide.espacenet.com/patent/search/family/051434798/publication/CN104017797A?q=CN104017797 (Year: 2024).*

Invitation to Pay Additional Fees for Application No. PCT/US2019/060652, mailed Dec. 18, 2019.

(56) References Cited

OTHER PUBLICATIONS

International Search Report and Written Opinion for Application No. PCT/US2019/060652, mailed Feb. 3, 2020.
International Preliminary Report on Patentability (Chapter II) for Application No. PCT/US2019/060652, mailed Feb. 18, 2021.
You et al., Molecular Cloning and Sequencing of an Allium macrostemon cDNA Probably Encoding Oxidosqualene Cyclase. Plant Biotechnol. 1999;16(4):311-314.
Abghari et al., Combinatorial Engineering of *Yarrowia lipolytica* as a Promising Cell Biorefinery Platform for the de novo Production of Multi-Purpose Long Chain Dicarboxylic Acids. Fermentation. Aug. 18, 2017;3(40):1-30. doi: :10.3390/fermentation3030040.
Gruchattka et al., In silico profiling of *Escherichia coli* and *Saccharomyces cerevisiae* as terpenoid factories. Microb Cell Fact. Sep. 23, 2013;12:84. doi: 10.1186/1475-2859-12-84.
Mishra et al., Genome-scale model-driven strain design for dicarboxylic acid production in *Yarrowia lipolytica*. BMC Syst Biol. Mar. 19, 2018;12(Suppl 2):12. doi: 10.1186/s12918-018-0542-5.
Paramasivan et al., Progress in terpene synthesis strategies through engineering of *Saccharomyces cerevisiae*. Crit Rev Biotechnol. Dec. 2017;37(8):974-989. doi: 10.1080/07388551.2017.1299679. Epub Apr. 20, 2017.
Sun et al., Identification of novel knockout targets for improving terpenoids biosynthesis in *Saccharomyces cerevisiae*. PLoS One. Nov. 11, 2014;9(11):e112615. doi: 10.1371/journal.pone.0112615.
Takahashi et al., Metabolic engineering of sesquiterpene metabolism in yeast. Biotechnol Bioeng. May 1, 2007;97(1):170-81. doi: 10.1002/bit.21216.
Vickers et al., Recent advances in synthetic biology for engineering isoprenoid production in yeast. Curr Opin Chem Biol. Oct. 2017;40:47-56. doi: 10.1016/j.cbpa.2017.05.017. Epub Jun. 14, 2017.
Wang et al., *Dekkera bruxellensis*, a beer yeast that specifically bioconverts mogroside extracts into the intense natural sweetener siamenoside I. Food Chem. Mar. 15, 2019;276:43-49. doi: 10.1016/j.foodchem.2018.09.163. Epub Sep. 29, 2018.
Xu et al., Emerging molecular biology tools and strategies for engineering natural product biosynthesis. Metab Eng Commun. Jun. 2020;10:e00108. doi: 10.1016/j.mec.2019.e00108. Epub Nov. 9, 2019.
Yee et al., Engineered mitochondrial production of monoterpenes in *Saccharomyces cerevisiae*. Metab Eng. Sep. 2019;55:76-84. doi: 10.1016/j.ymben.2019.06.004. Epub Jun. 19, 2019.
U.S. Appl. No. 17/924,659, filed Nov. 10, 2022, Boucher et al.
EP 19882275.1, Jul. 22, 2022, Extended European Search Report.
Extended European Search Report for Application No. EP 19882275. 1, mailed Jul. 22, 2022.
[No Author Listed], Mogroside. Wikipedia. Internet Archive Wayback Machine. Jan. 9, 2014 Accessible at: https://web.archive.org/web/20140109130110/http://en.wikipedia.org/wiki/Mogroside. Retrieved on Apr. 14, 2016. 1 page.
[No Author Listed], UDP-glycosyltransferases signature. Prosite Accession No. PS00375. Oct. 2, 20175. Internet Archive Wayback Machine. Accessible at https://web.archive.org/web/20171103215026/https:/prosite.expasy.org/PS00375. Retrieved on Nov. 3, 2017. 2 pages.
Arnesen et al., *Yarrowia lipolytica* Strains Engineered for the Production of Terpenoids. Front Bioeng Biotechnol. Aug. 14, 2020;8:945. doi: 10.3389/fbioe.2020.00945.
Badouin et al., The sunflower genome provides insights into oil metabolism, flowering and Asterid evolution. Nature. Jun. 1, 2017;546(7656):148-152. doi: 10.1038/nature22380. Epub May 22, 2017.
Bowles et al., Glycosyltransferases: managers of small molecules. Curr Opin Plant Biol. Jun. 2005;8(3):254-63. doi: 10.1016/j.pbi. 2005.03.007.
Bröker et al., Upregulating the mevalonate pathway and repressing sterol synthesis in *Saccharomyces cerevisiae* enhances the production of triterpenes. Appl Microbiol Biotechnol. Aug. 2018;102(16):6923-6934. doi: 10.1007/s00253-018-9154-7. Epub Jun. 15, 2018.

Chaturvedula et al., Additional cucurbitane glycosides from *Siraitia grosvenorii*. IOSR J Pharmacy (IOSRPHR). Jul. 2012;2(4):7-12. doi: 10.9790/3013-2420712.
Chaturvedula et al., Cucurbitane glycosides from *Siraitia grosvenorii*. J Carbohydrate Chem. Jun. 27, 2011;30(1):16-26. doi: 10.1080/07328303.2011.583511.
Cheng et al., Araport11: a complete reannotation of the *Arabidopsis thaliana* reference genome. Plant J. Feb. 2017;89(4):789-804. doi: 10.1111/tpj.13415. Epub Feb. 10, 2017.
Chiu et al., Biotransformation of mogrosides from *Siraitia grosvenorii* Swingle by *Saccharomyces cerevisiae*. J Agric Food Chem. Jul. 24, 2013;61(29):7127-34. doi: 10.1021/jf402058p. Epub Jul. 11, 2013.
Culp et al. Hidden antibiotics in actinomycetes can be identified by inactivation of gene clusters for common antibiotics. Nat Biotechnol. Oct. 2019;37(10):1149-1154. doi: 10.1038/s41587-019-0241-9. Epub Sep. 9, 2019.
Czajka et al., Engineering the oleaginous yeast *Yarrowia lipolytica* to produce the aroma compound β-ionone. Microb Cell Fact. Sep. 1, 2018;17(1):136. doi: 10.1186/s12934-018-0984-x.
Dai et al., Functional Characterization of Cucurbitadienol Synthase and Triterpene Glycosyltransferase Involved in Biosynthesis of Mogrosides from *Siraitia grosvenorii*. Plant Cell Physiol. Jun. 2015;56(6):1172-82. doi: 10.1093/pcp/pcv043. Epub Mar. 9, 2015.
Davidovich-Rikanati et al., Recombinant yeast as a functional tool for understanding bitterness and cucurbitacin biosynthesis in watermelon (*Citrullus* spp.). Yeast. Jan. 2015;32(1):103-14. doi: 10.1002/yea.3049. Epub Nov. 20, 2014.
Dewitte et al., Screening of recombinant glycosyltransferases reveals the broad acceptor specificity of stevia UGT-76G1. J Biotechnol. Sep. 10, 2016;233:49-55. doi: 10.1016/j.jbiotec.2016.06.034. Epub Jul. 1, 2016.
Furubayashi et al., A high-throughput colorimetric screening assay for terpene synthase activity based on substrate consumption. PLoS One. Mar. 28, 2014;9(3):e93317. doi: 10.1371/journal.pone. 0093317.
Gardner et al., An oxysterol-derived positive signal for 3-hydroxy-3-methylglutaryl-CoA reductase degradation in yeast. J Biol Chem. Mar. 23, 2001;276(12):8681-94. doi: 10.1074/jbc.M007888200. Epub Dec. 27, 2000.
Gou et al., Cytochrome $b_5$ Is an Obligate Electron Shuttle Protein for Syringyl Lignin Biosynthesis in *Arabidopsis*. Plant Cell. Jun. 2019;31(6):1344-1366. doi: 10.1105/tpc.18.00778. Epub Apr. 8, 2019.
Grubbs et al., Large-Scale Bioinformatics Analysis of *Bacillus* Genomes Uncovers Conserved Roles of Natural Products in Bacterial Physiology. mSystems. Nov. 14, 2017;2(6):e00040-17. doi: 10.1128/mSystems.00040-17.
Guo et al., Protein tolerance to random amino acid change. Proc Natl Acad Sci U S A. Jun. 22, 2004;101(25):9205-10. doi: 10.1073/pnas.0403255101. Epub Jun. 14, 2004.
Guo et al., Transcriptome sequencing and comparative analysis of cucumber flowers with different sex types. BMC Genomics. Jun. 17, 2010;11:384. doi: 10.1186/1471-2164-11-384.
Hamburger et al., Plant P450s as versatile drivers for evolution of species-specific chemical diversity. Philos Trans R Soc Lond B Biol Sci. Jan. 6, 2013;368(1612):20120426. doi: 10.1098/rstb.2012. 0426.
Huang et al., The genome of the cucumber, *Cucumis sativus* L. Nat Genet. Dec. 2009;41(12):1275-81. doi: 10.1038/ng.475. Epub Nov. 1, 2009.
International Brachypodium Initiative, Genome sequencing and analysis of the model grass *Brachypodium distachyon*. Nature. Feb. 11, 2010;463(7282):763-8. doi: 10.1038/nature08747.
International Peach Genome Initiative et al., The high-quality draft genome of peach (*Prunus persica*) identifies unique patterns of genetic diversity, domestication and genome evolution. Nat Genet. May 2013;45(5):487-94. doi: 10.1038/ng.2586. Epub Mar. 24, 2013.
Itkin et al., The biosynthetic pathway of the nonsugar, high-intensity sweetener mogroside V from *Siraitia grosvenorii*. Proc Natl Acad Sci U S A. Nov. 22, 2016;113(47):E7619-E7628 and Supplemental Material. doi: 10.1073/pnas.1604828113. Epub Nov. 7, 2016. Erratum in: Proc Natl Acad Sci U S A. Apr. 2, 2018. 79 pages.

(56) References Cited

OTHER PUBLICATIONS

Jia et al., A minor, sweet cucurbitane glycoside from *Siraitia grosvenorii*. Nat Prod Commun. Jun. 2009;4(6):769-72.

Jones et al., UGT73C6 and UGT78D1, glycosyltransferases involved in flavonol glycoside biosynthesis in *Arabidopsis thaliana*. J Biol Chem. Nov. 7, 2003;278(45):43910-8. doi: 10.1074/jbc.M303523200. Epub Aug. 4, 2003.

Kang et al., Genome sequence of mungbean and insights into evolution within *Vigna* species. Nat Commun. Nov. 11, 2014;5:5443. doi: 10.1038/ncomms6443.

Kasai et al., Sweet cucurbitane glycosides from fruits of *Siraitia siamensis* (chi-zi luo-han-guo), a Chinese folk medicine. Agricultural and biological chemistry. Dec. 1, 1989;53(12):3347-9.

Kim et al., In silico identification of metabolic engineering strategies for improved lipid production in *Yarrowia lipolytica* by genome-scale metabolic modeling. Biotechnol Biofuels. Jul. 24, 2019;12:187. doi: 10.1186/s13068-019-1518-4.

Kirby et al., Engineering triterpene production in *Saccharomyces cerevisiae*-β-amyrin synthase from *Artemisia annua*. FEBS J. Apr. 2008;275(8):1852-9. doi: 10.1111/j.1742-4658.2008.06343.x. Epub Mar. 8, 2008.

Kumar, S., Engineering cytochrome P450 biocatalysts for biotechnology, medicine and bioremediation. Expert Opin Drug Metab Toxicol. Feb. 2010;6(2):115-31. doi: 10.1517/17425250903431040.

Leushkin et al., The miniature genome of a carnivorous plant *Genlisea aurea* contains a low number of genes and short non-coding sequences. BMC Genomics. Jul. 15, 2013;14:476. doi: 10.1186/1471-2164-14-476.

Li et al., Cucurbitane glycosides from unripe fruits of Lo Han Kuo (*Siraitia grosvenori*). Chem Pharm Bull (Tokyo). Oct. 2006;54(10):1425-8.

Li et al., Phylogenetic analysis of the UDP-glycosyltransferase multigene family of *Arabidopsis thaliana*. J Biol Chem. Feb. 9, 2001;276(6):4338-43. doi: 10.1074/jbc.M007447200. Epub Oct. 20, 2000.

Li et al., Production of Rebaudioside A from Stevioside Catalyzed by the Engineered *Saccharomyces cerevisiae*. Appl Biochem Biotechnol. Apr. 2016;178(8):1586-98. doi: 10.1007/s12010-015-1969-4. Epub Jan. 6, 2016.

Li et al., RNA-Seq improves annotation of protein-coding genes in the cucumber genome. BMC Genomics. Nov. 2, 2011;12:540. doi: 10.1186/1471-2164-12-540.

Li et al., Systematic exploration of essential yeast gene function with temperature-sensitive mutants. Nat Biotechnol. Apr. 2011;29(4):361-7. doi: 10.1038/nbt.1832. Epub Mar. 27, 2011.

Lim et al., *Arabidopsis* glycosyltransferases as biocatalysts in fermentation for regioselective synthesis of diverse quercetin glucosides. Biotechnol Bioeng. Sep. 5, 2004;87(5):623-31. doi: 10.1002/bit.20154.

Lim et al., Identification of glucosyltransferase genes involved in sinapate metabolism and lignin synthesis in *Arabidopsis*. J Biol Chem. Feb. 9, 2001;276(6):4344-9. doi: 10.1074/jbc.M007263200. Epub Oct. 20, 2000.

Lin et al., Sequence and analysis of chromosome 2 of the plant *Arabidopsis thaliana*. Nature. Dec. 16, 1999;402(6763):761-8. doi: 10.1038/45471.

Lodeiro et al., A putative precursor of isomalabaricane triterpenoids from lanosterol synthase mutants. Org Lett. Feb. 2, 2006;8(3):439-42. doi: 10.1021/ol052725j.

Lorenz et al., Regulation of ergosterol biosynthesis and sterol uptake in a sterol-auxotrophic yeast. J Bacteriol. Aug. 1987;169(8):3707-11. doi: 10.1128/jb.169.8.3707-3711.1987.

Matsumoto et al., Minor cucurbitane-glycosides from fruits of *Siraitia grosvenori* (Cucurbitaceae). Chemical and pharmaceutical bulletin. Jul. 25, 1990;38(7):2030-2.

Mengin-Lecreulx et al., The murG gene of *Escherichia coli* codes for the UDP-N-acetylglucosamine: N-acetylmuramyl-(pentapeptide) pyrophosphoryl-undecaprenol N-acetylglucosamine transferase involved in the membrane steps of peptidoglycan synthesis. J Bacteriol. Aug. 1991;173(15):4625-36. doi: 10.1128/jb.173.15.4625-4636.1991.

Myburg et al., The genome of *Eucalyptus grandis*. Nature. Jun. 19, 2014;510(7505):356-62. doi: 10.1038/nature13308. Epub Jun. 11, 2014.

Oliaro-Bosso et al., Access of the substrate to the active site of squalene and oxidosqualene cyclases: comparative inhibition, site-directed mutagenesis and homology-modelling studies. Biochem Soc Trans. Nov. 2005;33(Pt 5):1202-5. doi: 10.1042/BST20051202.

Patro et al., Salmon provides fast and bias-aware quantification of transcript expression. Nat Methods. Apr. 2017;14(4):417-419. doi: 10.1038/nmeth.4197. Epub Mar. 6, 2017.

Poppenberger et al., Detoxification of the *Fusarium* mycotoxin deoxynivalenol by a UDP-glucosyltransferase from *Arabidopsis thaliana*. J Biol Chem. Nov. 28, 2003;278(48):47905-14. doi: 10.1074/jbc.M307552200. Epub Sep. 11, 2003.

Poppenberger et al., Heterologous expression of *Arabidopsis* UDP-glucosyltransferases in *Saccharomyces cerevisiae* for production of zearalenone-4-O-glucoside. Appl Environ Microbiol. Jun. 2006;72(6):4404-10. doi: 10.1128/AEM.02544-05.

Qiao et al., Modification of isoprene synthesis to enable production of curcurbitadienol synthesis in *Saccharomyces cerevisiae*. J Ind Microbiol Biotechnol. Feb. 2019;46(2):147-157. doi: 10.1007/s10295-018-2116-3. Epub Dec. 10, 2018.

Qin et al., Whole-genome sequencing of cultivated and wild peppers provides insights into *Capsicum* domestication and specialization. Proc Natl Acad Sci U S A. Apr. 8, 2014;111(14):5135-40. doi: 10.1073/pnas.1400975111. Epub Mar. 3, 2014.

Ren et al., An integrated genetic and cytogenetic map of the cucumber genome. PLoS One. Jun. 4, 2009;4(6):e5795. doi: 10.1371/journal.pone.0005795.

Richman et al., Functional genomics uncovers three glucosyltransferases involved in the synthesis of the major sweet glucosides of *Stevia rebaudiana*. Plant J. Jan. 2005;41(1):56-67. doi: 10.1111/j.1365-313X.2004.02275.x.

Saito et al., The flavonoid biosynthetic pathway in *Arabidopsis*: structural and genetic diversity. Plant Physiol Biochem. Nov. 2013;72:21-34. doi: 10.1016/j.plaphy.2013.02.001. Epub Feb. 16, 2013.

Schaffer et al., Cloning and targeted gene disruption of EXGI, encoding exo-β 1, 3-glucanase, in the phytopathogenic fungus *Cochliobolus carbonum*. Appl Environ Microbiol. Feb. 1994;60(2):594-8. doi: 10.1128/aem.60.2.594-598.1994.

Schmidt et al., Identification of a *Saccharomyces cerevisiae* glucosidase that hydrolyzes flavonoid glucosides. Appl Environ Microbiol. Mar. 2011;77(5):1751-7. doi: 10.1128/AEM.01125-10. Epub Jan. 7, 2011.

Seki et al., Functional annotation of a full-length *Arabidopsis* cDNA collection. Science. Apr. 5, 2002;296(5565):141-5. doi: 10.1126/science.1071006. Epub Mar. 21, 2002.

Seki et al., Licorice β-amyrin 11-oxidase, a cytochrome P450 with a key role in the biosynthesis of the triterpene sweetener glycyrrhizin. Proc Natl Acad Sci U S A. Sep. 16, 2008;105(37):14204-9. doi: 10.1073/pnas.0803876105. Epub Sep. 8, 2008.

Seki et al., Triterpene functional genomics in licorice for identification of CYP72A154 involved in the biosynthesis of glycyrrhizin. Plant Cell. Nov. 2011;23(11):4112-23. doi: 10.1105/tpc.110.082685. Epub Nov. 29, 2011.

Shang et al., Engineering Plant Cytochrome P450s for Enhanced Synthesis of Natural Products: Past Achievements and Future Perspectives. Plant Commun. Dec. 3, 2019;1(1):100012. doi: 10.1016/j.xplc.2019.100012.

Shao et al., Crystal structures of a multifunctional triterpene/flavonoid glycosyltransferase from *Medicago truncatula*. Plant Cell. Nov. 2005;17(11):3141-54. doi: 10.1105/tpc.105.035055. Epub Oct. 7, 2005.

Sharma et al., Genome-wide identification and tissue-specific expression analysis of UDP-glycosyltransferases genes confirm their abundance in *Cicer arietinum* (Chickpea) genome. PLoS One. Oct. 7, 2014;9(10):e109715. doi: 10.1371/journal.pone.0109715.

Shibuya et al., Cucurbitadienol synthase, the first committed enzyme for cucurbitacin biosynthesis, is a distinct enzyme from cycloartenol synthase for phytosterol biosynthesis. Tetrahedron. Aug. 9, 2004;60(33):6995-7003.

Silva-Junior et al., Genome assembly of the Pink Ipê (*Handroanthus impetiginosus, Bignoniaceae*), a highly valued, ecologically key-

(56) References Cited

OTHER PUBLICATIONS stone Neotropical timber forest tree. Gigascience. Jan. 1, 2018;7(1):1-16. doi: 10.1093/gigascience/gix125.
Slotte et al., The *Capsella rubella* genome and the genomic consequences of rapid mating system evolution. Nat Genet. Jul. 2013;45(7):831-5. doi: 10.1038/ng.2669. Epub Jun. 9, 2013.
Takase et al., Control of the 1,2-rearrangement process by oxidosqualene cyclases during triterpene biosynthesis. Org Biomol Chem. Jul. 14, 2015;13(26):7331-6. doi: 10.1039/c5ob00714c. Epub Jun. 10, 2015.
Tang et al., An efficient approach to finding *Siraitia grosvenorii* triterpene biosynthetic genes by RNA-seq and digital gene expression analysis. BMC Genomics. Jul. 5, 2011;12:343. doi: 10.1186/1471-2164-12-343.
Tian et al., Comparative Genomics Analysis of *Streptomyces* Species Reveals Their Adaptation to the Marine Environment and Their Diversity at the Genomic Level. Front Microbiol. Jun. 27, 2016;7:998. doi: 10.3389/fmicb.2016.00998.
Tomato Genome Consortium, The tomato genome sequence provides insights into fleshy fruit evolution. Nature. May 30, 2012;485(7400):635-41. doi: 10.1038/nature11119.
Van Velzen et al., Parallel loss of symbiosis genes in relatives of nitrogen-fixing non-legume *Parasponia*. bioRxiv preprint. Jul. 28, 2017. doi: https://doi.org/10.1101/169706.
Wang et al., [Downregulation of lanosterol synthase gene expression by antisense RNA technology in *Saccharomyces cerevisiae*]. Yao Xue Xue Bao. Jan. 2015;50(1):118-22. Chinese. Abstract.
Wang et al., Hyperproduction of β-Glucanase Exg1 Promotes the Bioconversion of Mogrosides in *Saccharomyces cerevisiae* Mutants Defective in Mannoprotein Deposition. J Agric Food Chem. Dec. 2, 2015;63(47):10271-9. doi: 10.1021/acs.jafc.5b03909. Epub Nov. 19, 2015.
Wang et al., Production of bioactive ginsenosides Rh2 and Rg3 by metabolically engineered yeasts. Metab Eng. May 2015;29:97-105. doi: 10.1016/j.ymben.2015.03.003. Epub Mar. 11, 2015.
Weiner et al., Rapid motif-based prediction of circular permutations in multi-domain proteins. Bioinformatics. Apr. 1, 2005;21(7):932-7. doi: 10.1093/bioinformatics/bti085.
Xia et al., Improved de novo genome assembly and analysis of the Chinese cucurbit *Siraitia grosvenorii*, also known as monk fruit or luo-han-guo. Gigascience Database. May 30, 2018:Supporting Information. doi: http://dx.doi.org/10.5524/100452. Accessible at http://gigadb.org/dataset/view/id/100452. 7 pages.
Xia et al., Improved de novo genome assembly and analysis of the Chinese cucurbit *Siraitia grosvenorii*, also known as monk fruit or luo-han-guo. Gigascience. Jun. 8, 2018;7(6):giy067. doi: 10.1093/gigascience/giy067. 9 pages.
Xiong et al., Biosynthesis of triterpene glycoside in Lo Han Kuo. J Guangdong Pharma Uni. 2011;27(5):544-5.

Yu et al., Circular permutation: a different way to engineer enzyme structure and function. Trends Biotechnol. Jan. 2011;29(1):18-25. doi: 10.1016/j.tibtech.2010.10.004. Epub Nov. 17, 2010.
Zhang et al., Oxidation of Cucurbitadienol Catalyzed by CYP87D18 in the Biosynthesis of Mogrosides from *Siraitia grosvenorii*. Plant Cell Physiol. May 2016;57(5):1000-7 and Supplemental Material. doi: 10.1093/pcp/pcw038. Epub Feb. 21, 2016. 17 pages.
Zwick et al., Genomic characterization of the *Bacillus cereus* sensu lato species: backdrop to the evolution of *Bacillus anthracis*. Genome Res. Aug. 2012;22(8):1512-24. doi: 10.1101/gr.134437.111. Epub May 29, 2012.
Altschul et al., Basic local alignment search tool. J Mol Biol. Oct. 5, 1990;215(3):403-10. doi: 10.1016/S0022-2836(05)80360-2.
Altschul et al., Gapped BLAST and PSI-BLAST: a new generation of protein database search programs. Nucleic Acids Res. Sep. 1, 1997;25(17):3389-402. doi: 10.1093/nar/25.17.3389.
Karlin et al., Applications and statistics for multiple high-scoring segments in molecular sequences. Proc Natl Acad Sci USA. Jun. 15, 1993;90(12):5873-7. doi: 10.1073/pnas.90.12.5873.
Karlin et al., Methods for assessing the statistical significance of molecular sequence features by using general scoring schemes. Proc Natl Acad Sci USA. Mar. 1990;87(6):2264-8. doi: 10.1073/pnas.87.6.2264.
Liu et al., Characterization of a thermostable β-glucosidase from *Aspergillus fumigatus* Z5, and its functional expression in Pichia pastoris X33. Microb Cell Fact. Feb. 17, 2012;11:25. doi: 10.1186/1475-2859-11-25.
Lodeiro et al., Enzyme redesign: two mutations cooperate to convert cycloartenol synthase into an accurate lanosterol synthase. J Am Chem Soc. Oct. 19, 2005;127(41):14132-3. doi: 10.1021/ja053791j.
Needleman et al., A general method applicable to the search for similarities in the amino acid sequence of two proteins. J Mol Biol. Mar. 1970;48(3):443-53. doi: 10.1016/0022-2836(70)90057-4.
Sievers et al., Fast, scalable generation of high-quality protein multiple sequence alignments using Clustal Omega. Mol Syst Biol. Oct. 11, 2011;7:539. doi: 10.1038/msb.2011.75.
Smith et al., Identification of common molecular subsequences. J Mol Biol. Mar. 25, 1981;147(1):195-7. doi: 10.1016/0022-2836(81)90087-5.
Suzuki et al., Lanosterol synthase in dicotyledonous plants. Plant Cell Physiol. May 2006;47(5):565-71. doi: 10.1093/pcp/pcj031. Epub Mar. 10, 2006.
Wishart et al., A single mutation converts a novel phosphotyrosine binding domain into a dual-specificity phosphatase. J Biol Chem. Nov. 10, 1995;270(45):26782-5. doi: 10.1074/jbc.270.45.26782.
Witkowski et al., Conversion of a β-ketoacyl synthase to a malonyl decarboxylase by replacement of the active-site cysteine with glutamine. Biochemistry. Sep. 7, 1999;38(36):11643-50. doi: 10.1021/bi990993h. Epub Aug. 18, 1999.

\* cited by examiner

```
UGT94-289-1   ---MDAQRGHTTTILMFPWLGYGHLSAFLELAKSLSRRNFHIYFCSTSVNLDAIKPKLPS  57
U73C6         MAFEKNNEPFPLHFVLPFMAQGHMIPMVDIARLLAQRGVLITIVTTPHNAARFKNVLNR   60
                .:., :::**::. **: :::*: *::*., * : :*  *   :*  *

UGT94-289-1   SS-SSDSIQLVELCLPSSPDQLPPHLHTTNALPP-HLMPTLHQAFSMAAQHFAAILHT--  113
U73C6         AIESGLPINLVQVKFPYQEAGLQEGQENMDLLTTMEQITSFFKAVNLLKEPVQNLIEEMS 120
               : *. *:**:: :* .      .. : *    .: ::.:*..:   :  . ::.

UGT94-289-1   LAPHLLIYDSFQPWAPQLASSLNIPAINENTTGASVLTRMLH------------------  155
U73C6         PRPSCLISDMCLSYTSEIAKKFKIPKILFHGMGCFCLLCVNVLRKNREILDNLKSDKEYF  180
               * ** *  ::  ::*...:** * *:  *.  *  :

UGT94-289-1   --------ATHYPSSKFPISEFVLHDYWKAMYSAAGGAVTKKDHKIGETLANCLHASCSVI  208
U73C6         IVPYFPDRVEFTRPQVPVETYVP-AGWKEILE---------------DMVEA-DKTSYGV  223
                     ..:  :..*:. :*    ** :.                   :.:. . :.  :

UGT94-289-1   LINSFRELEEKYMDYLSVLLNKKVVPVGPLVYEPN--------QDGEDEGYSSIKNWLDK  260
U73C6         IVNSFQELEPAYAKDFKEARSGKAWTIGPVSLCNKVGVDKAERGNKSDIDQDECLEWLDS  283
              ::****:***  *   .: .   .*  **:  :*           : .*  ...  :***.

UGT94-289-1   KEPSSTVFVSFGSEYFPSKEEMEEIAHGLEASEVHFIWVVRFPQGDNTSAIEDALPKGFL  320
U73C6         KEPGSVLYVCLGSICNLPLSQLLELGLGLEESQRPFIWVIRGWEKY-KELVEWFSESGFE  342
              ***.*.:::*.***    .:: *:.  ***  *: ****:* : . .:  *   .. .**

UGT94-289-1   ERVGERGMVVKGWAPQAKILKHWSTGGFVSHCGWNSVMESMMFGVPIIGVPMFLDQPFNA  380
U73C6         DRIQDRGLLIKGWSPQMLILSHPSVGGFLTHCGWNSTLEGITAGLPMLTWPIFADQFCNE  402
              :*: :**::****:**  :**.*  .*:  ******..: :.  **: * *:*:**:.*  *

UGT94-289-1   GLAEE-AGVGVEAKRDPDGK----------IQRDEVAKLIKEVVVEKTR-EDVRKKAREM  428
U73C6         KLVVQILKVGVSAEVKEVMKWGEEEKIGVLVDKEGVKKAVEELMGESDDAKERRRRAKEL  462
               *. :  ***.*:. .    *        ::::  *  ::*:: *.  :: *:::*:*:

UGT94-289-1   SEILRSKGEEKMDEMVAAISLFLKI----------  453
U73C6         GESAHKAVEEG-GSSHSNITFLLQDIMQLAQSNN   495
              .*  :. ** .. : *:::*:
```

FIG. 9

BIOSYNTHESIS OF MOGROSIDES

CROSS-REFERENCE TO RELATED APPLICATIONS

This application is a national stage filing under 35 U.S.C. § 371 of International Patent Application Serial No. PCT/US2019/060652, filed Nov. 9, 2019, entitled "BIOSYNTHESIS OF MOGROSIDES," which claims the benefit of priority under 35 U.S.C. § 119(e) of U.S. Provisional Application Ser. No. 62/758,474, filed Nov. 9, 2018, entitled "Biosynthesis of Mogrosides," the disclosure of each of which is incorporated by reference herein in its entirety.

REFERENCE TO A SEQUENCE LISTING SUBMITTED AS A TEXT FILE VIA EFS-WEB

The instant application contains a Sequence Listing which has been submitted in ASCII format via EFS-Web and is hereby incorporated by reference in its entirety. Said ASCII copy, created on May 7, 2021, is named G091970023US02-SEQ-FL.TXT and is 949,299 bytes in size.

FIELD OF THE INVENTION

The present disclosure relates to the production of mogrol precursors, mogrol and mogrosides in recombinant cells.

BACKGROUND

Mogrosides are glycosides of cucurbitane derivatives. Highly sought after as sweeteners and sugar alternatives, mogrosides are naturally synthesized in the fruits of plants, including *Siraitia grosvenorii* (*S. grosvenorii*). Although anti-cancer, anti-oxidative, and anti-inflammatory properties have been ascribed to mogrosides, characterization of the exact enzymes involved in mogroside biosynthesis is limited. Furthermore, mogroside extraction from fruit is labor-intensive and the structural complexity of mogrosides often hinders de novo chemical synthesis.

SUMMARY

Aspects of the invention relate to a host cell that comprises a heterologous polynucleotide encoding a UDP-glycosyltransferase (UGT), wherein the UGT comprises a region that: corresponds to residues 83 to 92 of wild-type UGT94-289-1 (SEQ ID NO: 109), wherein the region comprises an amino acid substitution relative to residues 83 to 92 of wild-type UGT94-289-1 (SEQ ID NO: 109); and/or corresponds to residues 179 to 198 of wild-type UGT94-289-1 (SEQ ID NO: 109), wherein the region comprises an amino acid substitution relative to residues 179 to 198 of wild-type UGT94-289-1 (SEQ ID NO: 109); wherein the host cell produces in the presence of at least one mogroside precursor at least 10%, 20%, 30%, 40%, 50%, 60%, 70%, 80%, 90%, or 100% more of one or more mogrosides relative to a control host cell that comprises a heterologous polynucleotide encoding wild-type UGT94-289-1 (SEQ ID NO: 109).

In some embodiments, the UGT exhibits at least a 1.3-fold increase in activity (e.g., specific activity) relative to wild-type UGT94-289-1 (SEQ ID NO: 109). In some embodiments, the UGT comprises an amino acid substitution at an amino acid residue located in a structural motif corresponding to a structural motif in wild-type UGT94-289-1 (SEQ ID NO: 109) selected from: loop 6, alpha helix 3, loop 11, alpha helix 6, loop 12, and alpha helix 7. In some embodiments, the UGT is capable of catalyzing conversion of: Mogrol to MIA1; Mogrol to MIE1; MIA1 to MIIA1; MIE1 to MIIE; MIIA1 to MIIIA1; MIA1 to MIIE; MIIA1 to MIII; MIIIA1 to siamenoside I; MIIE to MIII; MIII to siamenoside I; MIIE to MIIIE; and/or MIIIE to siamenoside I. In some embodiments, the UGT is capable of: glycosylation of mogrol at C24; glycosylation of mogroside at C3; branching glycosylation of mogroside at C3; or branching glycosylation of mogroside C24. In some embodiments, the UGT comprises an amino acid substitution at an amino acid residue corresponding to the amino acid residue in wild-type UGT94-289-1 (SEQ ID NO: 109) selected from: H83; T84; T85; N86; P89; L92; Y179; S180; A181; G184; A185; V186; T187; K189; H191; K192; G194; E195; and A198. In some embodiments, the host cell further comprises a heterologous polynucleotide encoding a cucurbitadienol synthase (CDS) enzyme.

Further aspects of the invention relate to a host cell that comprises a heterologous polynucleotide encoding a UGT, wherein the UGT comprises a region that: corresponds to residues 83 to 92 of wild-type UGT94-289-1 (SEQ ID NO: 109), wherein the region comprises an amino acid substitution relative to residues 83 to 92 of wild-type UGT94-289-1 (SEQ ID NO: 109); and/or corresponds to residues 179 to 198 of wild-type UGT94-289-1 (SEQ ID NO: 109) wherein the region comprises an amino acid substitution relative to residues 179 to 198 of wild-type UGT94-289-1 (SEQ ID NO: 109); wherein the UGT comprises less than 90% identity to SEQ ID NO: 109.

In some embodiments, the UGT exhibits at least a 1.3-fold increase in activity (e.g., specific activity) relative to wild-type UGT94-289-1 (SEQ ID NO: 109). In some embodiments, the UGT comprises an amino acid substitution at an amino acid residue located in a structural motif corresponding to a structural motif in wild-type UGT94-289-1 (SEQ ID NO: 109) selected from: loop 6, alpha helix 3, loop 11, alpha helix 6, loop 12, and alpha helix 7. In some embodiments, the UGT is capable of catalyzing conversion of: Mogrol to MIA1; Mogrol to MIE1; MIA1 to MIIA1; MIE1 to MIIE; MIIA1 to MIIIA1; MIA1 to MIIE; MIIA1 to MIII; MIIIA1 to siamenoside I; MIIE to MIII; MIII to siamenoside I; MIIE to MIIIE; and/or MIIIE to siamenoside I. In some embodiments, the UGT is capable of: glycosylation of mogrol at C24; glycosylation of mogroside at C3; branching glycosylation of mogroside at C3; or branching glycosylation of mogroside C24. In some embodiments, the host cell further comprises a heterologous polynucleotide encoding a CDS enzyme.

Further aspects of the invention relate to a host cell that comprises a heterologous polynucleotide encoding a UGT, wherein the UGT comprises an amino acid substitution at a residue corresponding to N143 or L374 of wild-type UGT94-289-1 (SEQ ID NO: 109), wherein the host cell produces in the presence of at least one mogroside precursor at least 10%, 20%, 30%, 40%, 50%, 60%, 70%, 80%, 90%, or 100% more of one or more mogrosides relative to a host cell that comprises a heterologous polynucleotide encoding wild-type UGT94-289-1 (SEQ ID NO: 109).

In some embodiments, the UGT exhibits at least a 1.3-fold increase in activity (e.g., specific activity) relative to wild-type UGT94-289-1 (SEQ ID NO: 109). In some embodiments, the UGT comprises an amino acid substitution at an amino acid residue located in a structural motif of the UGT corresponding to a structural motif in wild-type UGT94-289-1 (SEQ ID NO: 109) selected from: loop 6, alpha helix 3, loop 11, alpha helix 6, loop 12, and alpha helix 7. In some embodiments, the UGT is capable of catalyzing conversion of: Mogrol to MIA1; Mogrol to MIE1; MIA1 to MIIA1; MIE1 to MIIE; MIIA1 to MIIIA1; MIA1 to MIIE; MIIA1 to MIII; MIIIA1 to siamenoside I; MIIE to MIII; MIII to siamenoside I; MIIE to MIIIE; and/or MIIIE to siamenoside I. In some embodiments, the UGT is capable of: glycosylation of mogrol at C24; glycosylation of mogroside at C3; branching glycosylation of mogroside at C3; or branching glycosylation of mogroside C24. In some embodiments, the host cell further comprises a heterologous polynucleotide encoding a CDS enzyme.

Further aspects of the invention relate to a host cell that comprises a heterologous polynucleotide encoding a UGT, wherein the UGT comprises an amino acid substitution at an amino acid residue located in a structural motif corresponding to a structural motif of wild-type UGT94-289-1 (SEQ ID NO: 109) selected from: loop 8; beta sheet 5; loop 10; alpha helix 5; loop 11; loop 2; alpha helix 6; loop 12; alpha helix 1; alpha helix 7; loop 18; alpha helix 14; loop 26; alpha helix 2; loop 6; and alpha helix 3; wherein the host cell produces in the presence of at least one mogroside precursor at least 10%, 20%, 30%, 40%, 50%, 60%, 70%, 80%, 90%, or 100% more of one or more mogrosides relative to a host cell that comprises a heterologous polynucleotide encoding a UGT that does not comprise the amino acid substitution.

In some embodiments, the UGT exhibits at least a 1.3-fold increase in activity (e.g., specific activity) relative to wild-type UGT94-289-1 (SEQ ID NO: 109). In some embodiments, the UGT is capable of catalyzing conversion of: Mogrol to MIA1; Mogrol to MIE1; MIA1 to MIIA1; MIE1 to MIIE; MIIA1 to MIIIA1; MIA1 to MIIE; MIIA1 to MIII; MIIIA1 to siamenoside I; MIIE to MIII; MIII to siamenoside I; MIIE to MIIIE; and/or MIIIE to siamenoside I. In some embodiments, the UGT is capable of: glycosylation of mogrol at C24; glycosylation of mogroside at C3; branching glycosylation of mogroside at C3; or branching glycosylation of mogroside C24. In some embodiments, the host cell further comprises a heterologous polynucleotide encoding a CDS enzyme.

Further aspects of the invention relate to a host cell that comprises a heterologous polynucleotide encoding a UGT, wherein the UGT comprises an amino acid substitution at an amino acid residue that is within 7 angstrom of a catalytic dyad corresponding to H21/D122 of wildtype UGT94-289-1 (SEQ ID NO: 109), wherein the UGT exhibits at least a 1.3-fold increase in activity (e.g., specific activity) relative to the same UGT not comprising the amino acid substitution.

Further aspects of the invention relate to host cells that comprises a heterologous polynucleotide encoding a circularly permutated UDP-glycosyltransferase (UGT), wherein the circularly permutated UGT comprises: (a) a catalytic dyad; and (b) a cofactor binding site; wherein the catalytic dyad is located C-terminal to the cofactor-binding site, and wherein the host cell produces in the presence of at least one mogroside precursor at least 10%, 20%, 30%, 40%, 50%, 60%, 70%, 80%, 90%, or 100% more of one or more mogrosides relative to a control host cell that comprises a heterologous polynucleotide encoding wild-type UGT94-289-1 (SEQ ID NO: 109).

In some embodiments, a circularly permutated UGT comprises a sequence that is at least 90% identical to a sequence within Table 6.

In some embodiments, a UGT described in this application comprises a sequence that is at least 90% identical to a sequence within Table 3 or Table 7.

In some embodiments, the UGT comprises an amino acid substitution at an amino acid residue located in a structural motif corresponding to a structural motif in wild-type UGT94-289-1 (SEQ ID NO: 109) selected from: loop 6, alpha helix 3, loop 11, alpha helix 6, loop 12, and alpha helix 7.

In some embodiments, the UGT exhibits at least a 1.3-fold increase in activity (e.g., specific activity) relative to wild-type UGT94-289-1 (SEQ ID NO: 109). In some embodiments, the host cell produces in the presence of at least one mogroside precursor at least 40%, 50%, 60%, 70%, 80%, 90%, or 100% more of one or more mogrosides relative to a host cell that comprises a heterologous polynucleotide encoding a UGT that does not comprise the amino acid substitution.

In some embodiments, the UGT is capable of catalyzing conversion of: Mogrol to MIA1; Mogrol to MIE1; MIA1 to MIIA1; MIE1 to MIIE; MIIA1 to MIIIA1; MIA1 to MIIE; MIIA1 to MIII; MIIIA1 to siamenoside I; MIIE to MIII; MIII to siamenoside I; MIIE to MIIIE; and/or MIIIE to siamenoside I. In some embodiments, the UGT is capable of: glycosylation of mogrol at C24; glycosylation of mogroside at C3; branching glycosylation of mogroside at C3; or branching glycosylation of mogroside C24. In some embodiments, the host cell further comprises a heterologous polynucleotide encoding a CDS enzyme.

In some embodiments, the specific activity of the UGT is at least 1 mmol glycosylated mogroside target produced per gram of enzyme per hour.

Further aspects of the invention relate to a host cell that comprises a heterologous polynucleotide encoding a UGT, wherein the UGT comprises an amino acid substitution at an amino acid residue corresponding to the amino acid residue in wild-type UGT94-289-1 (SEQ ID NO: 109) selected from: H83; T84; T85; N86; P89; L92; Y179; S180; A181; G184; A185; V186; T187; K189; H191; K192; G194; E195; and A198.

Further aspects of the invention relate to a host cell that comprises a heterologous polynucleotide encoding a UGT, wherein the UGT comprises an amino acid substitution at an amino acid residue corresponding to the amino acid residue in wild-type UGT94-289-1 (SEQ ID NO: 109) selected from: G18; Y19; S123; N47; F124; N143, T144; T145; V149; F276; N355; H373 and L374.

In some embodiments, the UGT is capable of catalyzing conversion of: Mogrol to MIA1; Mogrol to MIE1; MIA1 to MIIA1; MIE1 to MIIE; MIIA1 to MIIIA1; MIA1 to MIIE; MIIA1 to MIII; MIIIA1 to siamenoside I; MIIE to MIII; MIII to siamenoside I; MIIE to MIIIE; and/or MIIIE to siamenoside I. In some embodiments, the UGT is capable of: glycosylation of mogrol at C24; glycosylation of mogroside at C3; branching glycosylation of mogroside at C3; or branching glycosylation of mogroside C24. In some embodiments, the UGT exhibits at least a 1.3-fold increase in activity (e.g., specific activity) relative to wildtype UGT94-289-1 (SEQ ID NO: 109). In some embodiments, the host cell produces in the presence of at least one mogroside precursor at least 10%, 20%, 30%, 40%, 50%, 60%, 70%, 80%, 90%, or 100% more of one or more mogrosides relative to a host cell that comprises a heterologous polynucleotide encoding wild-type UGT94-289-1 (SEQ ID NO: 109).

In some embodiments, Y179 is mutated to glutamate, phenylalanine, histidine, isoleucine, lysine, leucine, valine, or tryptophan; S180 is mutated to alanine or valine; A181 is mutated to lysine or threonine; G184 is mutated to alanine, cysteine, aspartate, glutamate, phenylalanine, histidine, isoleucine, lysine, methionine, asparagine, proline, glutamine, arginine, serine, threonine, or tyrosine; A185 is mutated to cysteine, aspartate, glutamate, glycine, lysine, leucine, methionine, asparagine, proline, glutamine, threonine, tryptophan or tyrosine; V186 is mutated to alanine, cysteine, aspartate, glutamate, glycine, isoleucine, lysine, leucine, methionine, asparagine, proline, glutamine, arginine, threonine, tryptophan, or tyrosine; T187 is mutated to alanine, cysteine, aspartate, glutamate, glycine, histidine, isoleucine, lysine, leucine, asparagine, proline, arginine, serine, valine, tryptophan, or tyrosine; K189 is mutated to alanine, cysteine, aspartate, glutamate, phenylalanine, glycine, histidine, isoleucine, leucine, methionine, proline, glutamine, arginine, serine, threonine, valine, tryptophan, or tyrosine; H191 is mutated to alanine, cysteine, aspartate, glutamate, glycine, lysine, methionine, proline, glutamine, serine, threonine, valine, tryptophan, or tyrosine; K192 is mutated to cysteine or phenylalanine; G194 is mutated to aspartate, leucine, methionine, asparagine, proline, serine, or tryptophan; E195 is mutated to alanine, isoleucine, lysine, leucine, asparagine, glutamine, serine, threonine, or tyrosine; A198 is mutated to cysteine, aspartate, glutamate, phenylalanine, histidine, isoleucine, lysine, leucine, methionine, asparagine, proline, glutamine, arginine, serine, threonine, valine, or tyrosine; H83 is mutated to glutamine or tryptophan; T84 is mutated to tyrosine; T85 is mutated to glycine, lysine, proline, serine, or tyrosine; N86 is mutated to alanine, cysteine, glutamate, isoleucine, lysine, leucine, serine, tryptophan, or tyrosine; P89 is mutated to methionine or serine; and/or L92 is mutated to histidine or lysine.

In some embodiments, N143 is mutated to alanine, cysteine, glutamate, isoleucine, leucine, methionine, glutamine, serine, threonine or valine; L374 is mutated to alanine, cysteine, phenylalanine, histidine, methionine, asparagine, glutamine, serine, threonine, valine, tryptophan, or tyrosine; S123 is mutated to alanine, cysteine, glycine or valine; F124 is mutated to tyrosine; T144 is mutated to alanine, cysteine, asparagine or proline; T145 is mutated to alanine, cysteine, glycine, methionine, asparagine, glutamine, or serine; V149 is mutated to cysteine, leucine or methionine; G18 is mutated to serine; Y19 is mutated to phenylalanine, histidine, leucine, or valine; F276 is mutated to cysteine or glutamine; N355 is mutated to glutamine or serine; H373 is mutated to lysine, leucine, methionine, arginine, valine, or tyrosine; and/or N47 is mutated to glycine.

In some embodiments, the host cell further comprises a heterologous polynucleotide encoding a CDS enzyme, a C11 hydroxylase, a cytochrome P450 reductase, an epoxide hydrolase (EPH), and/or a squalene epoxidase. In some embodiments, the heterologous polynucleotide encoding the CDS is at least 90% identical to SEQ ID NOs: 3, 9, or 12. In some embodiments, the CDS is at least 90% identical to SEQ ID NOs: 43, 49, or 52.

In some embodiments, the activity (e.g., specific activity) of the UGT is at least 1 mmol glycosylated mogroside target produced per gram of enzyme per hour. In some embodiments, the cell is a yeast cell, a plant cell, or a bacterial cell. In some embodiments, the cell is a *Saccharomyces cerevisiae* (*S. cerevisiae*) cell. In some embodiments, the cell is an *Escherichia coli* (*E. coli*) cell.

Further aspects of the invention relate to methods of producing a mogroside comprising culturing any of the host cells described in this application with at least one mogroside precursor. In some embodiments, the mogroside precursor is selected from mogrol, MIA1, MIIA1, MIIIA1, MIIE, MIII, and MIIIE. In some embodiments, the mogroside that is produced is selected from MIA1, MIIA1, MIIIA1, MIIE, MIII, siamenoside, and MIIIE.

Further aspects of the invention relate to a host cell that comprises a heterologous polynucleotide encoding a CDS enzyme, wherein the CDS enzyme comprises an amino acid sequence that is at least 90% identical to a sequence selected from the sequences within Table 2 and wherein the host cell produces at least 10%, 20%, 30%, 40%, 50%, 60%, 70%, 80%, 90%, or 100% more cucurbitadienol compound compared to the same host cell that does not express the heterologous gene.

In some embodiments, the cucurbitadienol compound is 24-25 epoxy-cucurbitadienol or cucurbitadienol. In some embodiments, the CDS enzyme comprises a leucine at the amino acid residue corresponding to the amino acid residue at position 123 of SEQ ID NO: 73. In some embodiments, the CDS is capable of converting an oxidosqualene to the cucurbitadienol compound. In some embodiments, the oxidosqualene is 2-3-oxidosqualene or 2,3; 22,23-diepoxysqualene. In some embodiments, the CDS enzyme comprises a substrate channel and an active-site cavity.

In some embodiments, the host cell further expresses a heterologous gene encoding a C11 hydroxylase enzyme, a cytochrome P450 reductase enzyme, an epoxide hydrolase (EPH) enzyme, and/or a squalene epoxidase enzyme.

Further aspects of the invention relate to a method of producing a cucurbitadienol compound, comprising contacting a host cell described in this application with an oxidosqualene, thereby producing the cucurbitadienol compound. In some embodiments, the cucurbitadienol compound is 24-25 epoxy-cucurbitadienol or cucurbitadienol. In some embodiments, the oxidosqualene is 2-3-oxidosqualene or 2,3; 22,23-diepoxysqualene. In some embodiments, the method further comprises isolating the cucurbitadienol compound.

Further aspects of the invention relate to a method of producing mogrol or a mogroside, comprising contacting a host cell described in this application with an oxidosqualene, thereby producing the mogrol or mogroside. Further aspects of the invention relate to a method of producing a mogroside comprising culturing a host cell described in this application with at least one mogroside precursor.

Further aspects of the invention relate to host cells that comprise a heterologous polynucleotide encoding a cucurbitadienol synthase (CDS) enzyme, wherein the CDS comprises: a) the motif GX$_1$WASDLGGP (SEQ ID NO: 331), wherein X$_1$ is N or H; b) the motif DX$_1$GWL (SEQ ID NO: 332), wherein X$_1$ is H or Q; and/or c) the motif CWGVCFTYAGW (SEQ ID NO: 333), wherein the CDS does not comprise the sequence of *S. grosvenorii* CDS (SEQ ID NO: 73); and wherein the host cell produces at least 10%, 20%, or 30% more cucurbitadienol compound relative to a control, wherein the control is a host cell that expresses *S. grosvenorii* CDS, encoded by a polynucleotide corresponding to SEQ ID NO:33.

In some embodiments, the motif GX$_1$WASDLGGP (SEQ ID NO: 331) is located at residues in the CDS corresponding to residues 117-126 in SEQ ID NO: 73; the motif DX$_1$GWL (SEQ ID NO: 332) is located at residues in the CDS corresponding to residues 479-483 in SEQ ID NO: 73, and/or the motif CWGVCFTYAGW (SEQ ID NO: 333) is located at residues in the CDS corresponding to residues 612-622 in SEQ ID NO: 73.

Further aspects of the invention relate to host cells that comprises a heterologous polynucleotide encoding a cucurbitadienol synthase (CDS) enzyme, wherein the CDS comprises: a) the motif GHWASDLGGP (SEQ ID NO: 334); and/or b) the motif DQGWL (SEQ ID NO: 335).

In some embodiments, the motif GHWASDLGGP (SEQ ID NO: 334) is located at residues in the CDS corresponding to residues 117-126 in SEQ ID NO: 73; and/or the motif DQGWL (SEQ ID NO: 335) is located at residues in the CDS corresponding to residues 479-483 in SEQ ID NO: 73.

Further aspects of the invention relate to host cells that comprise a heterologous polynucleotide encoding a cucurbitadienol synthase (CDS) enzyme, wherein the CDS comprises: a) the motif GHWANDLGGP (SEQ ID NO: 336); b) the motif DQGWL (SEQ ID NO: 335); and/or c) the motif CWGVCYTYAGW (SEQ ID NO: 337).

In some embodiments, the motif GHWANDLGGP (SEQ ID NO: 336) is located at residues in the CDS corresponding to residues 117-126 in SEQ ID NO: 73; the motif DQGWL (SEQ ID NO: 335) is located at residues in the CDS corresponding to residues 479-483 in SEQ ID NO: 73; and/or the motif CWGVCYTYAGW (SEQ ID NO: 337) is located at residues in the CDS corresponding to residues 612-622 in SEQ ID NO: 73.

In some embodiments, the heterologous polynucleotide is at least 90% identical to SEQ ID NOs: 3, 9, or 12. In some embodiments, the CDS is at least 90% identical to SEQ ID NOs: 43, 49, or 52. In some embodiments, the heterologous polynucleotide is at least 90% identical to SEQ ID NO: 3. In some embodiments, the CDS is at least 90% identical to SEQ ID NOs: 43.

Further aspects of the invention relate to host cells that comprise a heterologous polynucleotide encoding a cucurbitadienol synthase (CDS) enzyme, wherein the heterologous polynucleotide sequence is at least 90% identical to SEQ ID NO: 3 and/or the amino acid sequence of the CDS encoded by the heterologous polynucleotide is at least 90% identical to SEQ ID NO: 43, and wherein the host cell produces a cucurbitadienol compound.

In some embodiments, the cucurbitadienol compound is 24-25 epoxy-cucurbitadienol or cucurbitadienol. In some embodiments, the CDS comprises a leucine at the amino acid residue corresponding to the amino acid residue at position 123 of SEQ ID NO: 73. In some embodiments, the CDS is capable of converting an oxidosqualene to the cucurbitadienol compound. In some embodiments, the oxidosqualene is 2-3-oxidosqualene or 2,3; 22,23-diepoxysqualene. In some embodiments, the CDS enzyme comprises a substrate channel and an active-site cavity.

In some embodiments, the host cell further comprises aone or more heterologous polynucleotides encoding a UDP-glycosyltransferase (UGT), a C11 hydroxylase, a cytochrome P450 reductase, an epoxide hydrolase (EPH), and/or a squalene epoxidase.

Further aspects of the invention relate to methods of producing a cucurbitadienol compound, comprising contacting any of the host cells described in this application with an oxidosqualene, thereby producing the cucurbitadienol compound. In some embodiments, the cucurbitadienol compound is 24-25 epoxy-cucurbitadienol or cucurbitadienol. In some embodiments, the oxidosqualene is 2-3-oxidosqualene or 2,3; 22,23-diepoxysqualene. In some embodiments, the method further comprises isolating the cucurbitadienol compound. In some embodiments, the host cell is a yeast cell, a plant cell, or a bacterial cell. In some embodiments, the host cell is a *Saccharomyces cerevisiae* cell. In some embodiments, the host cell is an *E. coli* cell.

Each of the limitations of the invention can encompass various embodiments of the invention. It is, therefore, anticipated that each of the limitations of the invention involving any one element or combinations of elements can be included in each aspect of the invention. This invention is not limited in its application to the details of construction and the arrangement of components set forth in the following description or illustrated in the drawings. The invention is capable of other embodiments and of being practiced or of being carried out in various ways.

BRIEF DESCRIPTION OF DRAWINGS

The accompanying drawings are not intended to be drawn to scale. The drawings are illustrative only and are not required for enablement of the disclosure. For purposes of clarity, not every component may be labeled in every drawing. In the drawings:

FIG. 1A and FIG. 1B show putative mogrol biosynthesis pathways. FIG. 1C shows non-limiting examples of primary UGT activity. FIG. 1D shows non-limiting examples of secondary UGT activity.

FIG. 9 is a schematic depicting a non-limiting example of an alignment between the UGT U73C6 (SEQ ID NO: 103) and UGT94-289-1 (SEQ ID NO: 109). Boxes highlight residues in U73C6 (SEQ ID NO: 103) corresponding to positions 123, 143, and 273 in UGT94-289-1 (SEQ ID NO: 109).

DETAILED DESCRIPTION

Mogrosides are widely used as natural sweeteners, for example in beverages. However, de novo synthesis and mogroside extraction from natural sources often involves high production costs and low yield. This application describes host cells that are engineered to efficiently produce mogrol (or 11,24,25-trihydroxy cucurbitadienol), mogrosides, and precursors thereof. Methods include heterologous expression of cucurbitadienol synthase (CDS) enzymes, UDP-glycosyltransferase (UGT) enzymes, C11 hydroxylase enzymes, cytochrome P450 reductase enzymes, epoxide hydrolase (EPH) enzymes, squalene epoxidase (SQE) enzymes, or combinations thereof. This application describes the identification of improved UGT and CDS enzymes for mogrol and mogroside production. Enzymes and host cells described in this application can be used for making mogrol, mogrosides, and precursors thereof.

Synthesis of Mogrol and Mogrosides

Figure 1A:
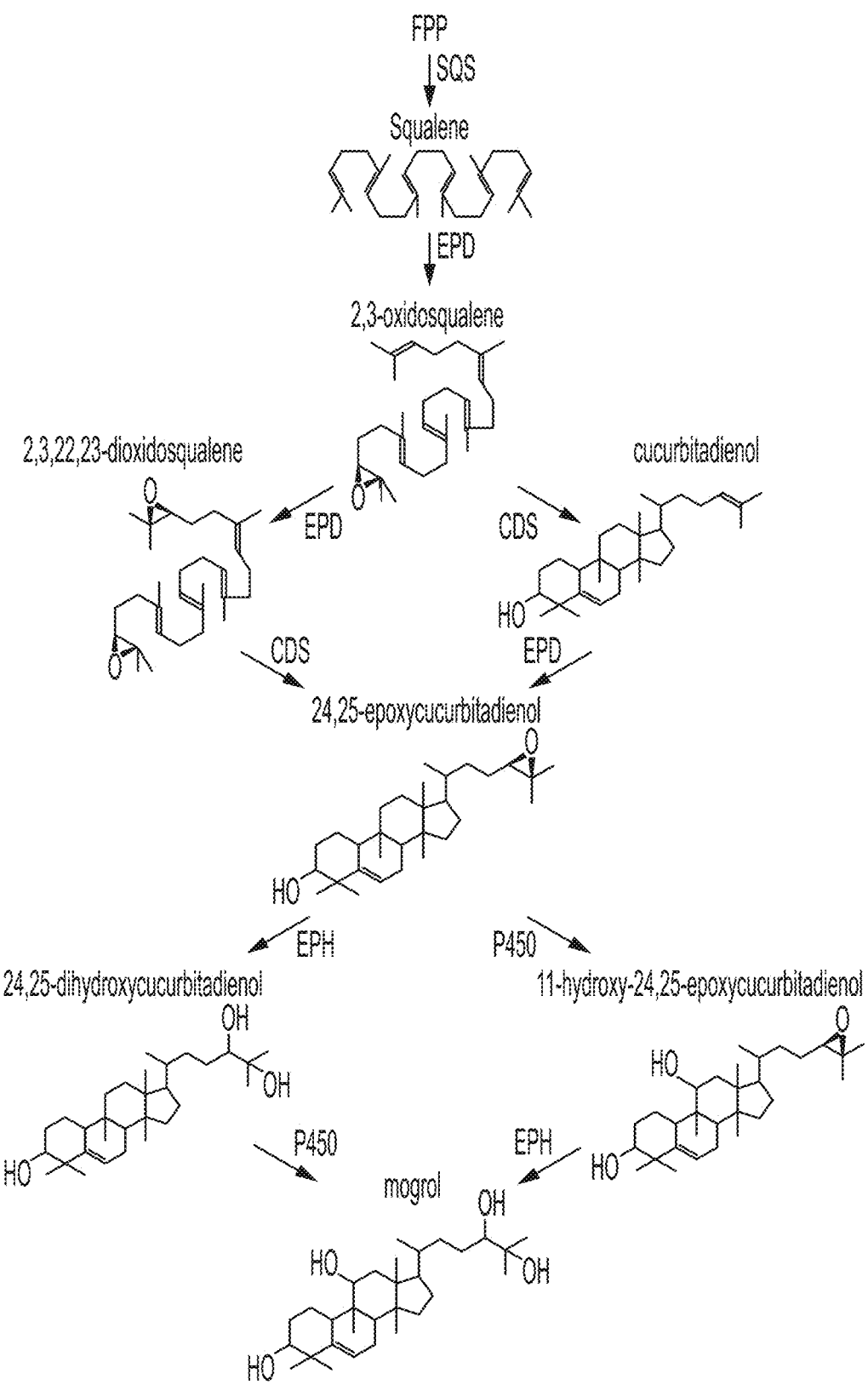
FIGS. 1A-1D include schematic overviews of putative mogrol biosynthesis pathways. SQS indicates squalene synthase, EPD indicates epoxidase, P450 indicates C11 hydroxylase, EPH indicates epoxide hydrolase, and CDS indicates cucurbitadienol synthase.
Figure 1B:
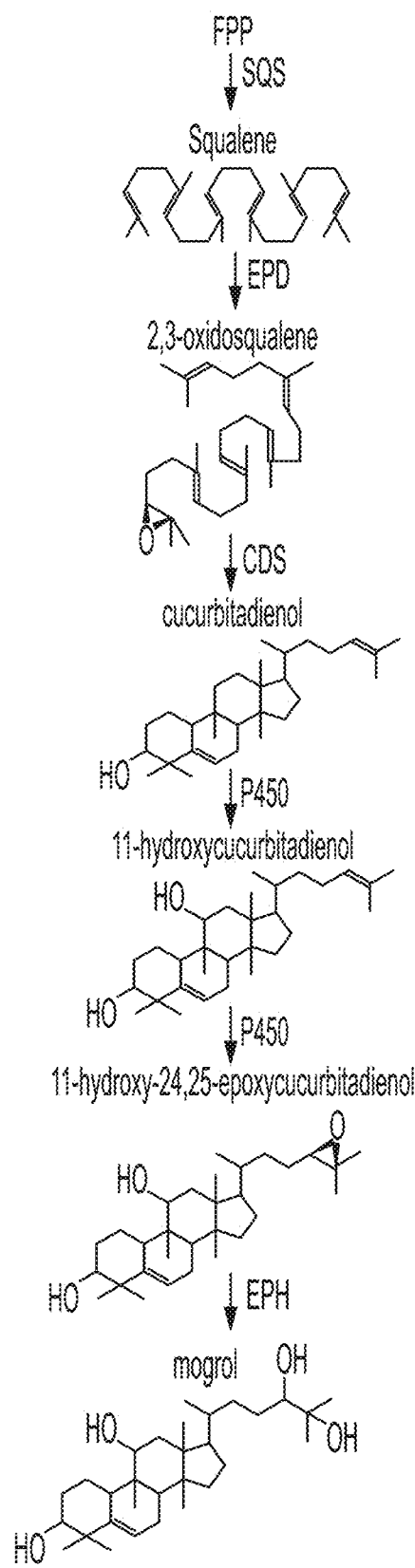
Figure 2:
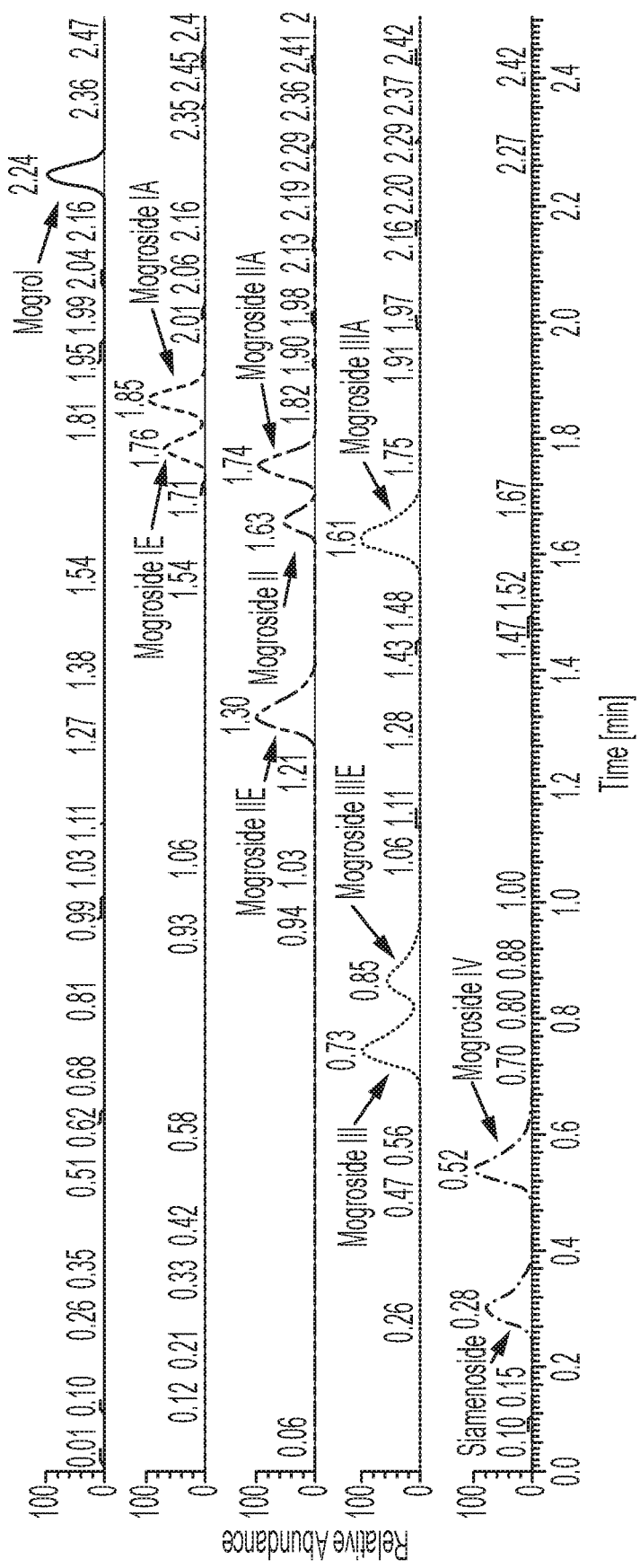
FIG. 2 is a graph showing liquid chromatography-mass spectrometry (LC-MS) profiles of mogrol, mogroside I-A1, mogroside I-E1, mogroside II-A1, mogroside II-A2, mogroside II-E, mogroside III-A1, mogroside III-E, mogroside IV, and siamenoside I. An 8 minute LC-MS method was used to distinguish between all these mogroside standards.

FIGS. 1A-1B show putative mogrol synthesis pathways. An early step in the pathway involves conversion of squalene to 2,3-oxidoqualene. As shown in FIG. 1A, 2,3-oxidosqualene can be first cyclized to cucurbitadienol followed by epoxidation to form 24,25-epoxycucurbitadienol, or 2,3-oxidosqualene can be epoxidized to 2,3,22,23-dioxidosqualene and then cyclized to 24,25-epoxycucurbitadienol. Next, the 24,25-epoxycucurbitadienol can be converted to mogrol (an aglycone of mogrosides) following epoxide hydrolysis and then oxidation, or oxidation and then epoxide hydrolysis. As shown in FIG. 1B, 2,3-oxidosqualene can be first cyclized to cucurbitadienol, which is then converted to 11-hydroxycucurbitadienol by a cytochrome P450 C11 hydroxylase. Then, a cytochrome P450 C11 hydroxylase may convert 11-hydroxycucurbitadienol to 11-hydroxy-24,25-epoxycucurbitadienol. 11-hydroxy-24,25-epoxycucurbitadienol may be converted to mogrol by epoxide hydrolase. C11 hydroxylases act in conjunction with cytochrome P450 reductases (not shown in FIGS. 1A-1B).

Mogrol can be distinguished from other cucurbitane triterpenoids by oxygenations at C3, C11, C24, and C25. Glycosylation of mogrol, for example at C3 and/or C24, leads to the formation of mogrosides.

Mogrol precursors include but are not limited to squalene, 2-3-oxidosqualene, 2,3,22,23-dioxidosqualene, cucurbitadienol, 24,25-expoxycucurbitadienol, 11-hydroxycucurbitadienol, 11-hydroxy-24,25-epoxycucurbitadienol, 11-hydroxycucurbitadienol, 11-oxo-cucurbitadienol, and 24,25-dihydroxycucurbitadienol. The term "dioxidosqualene" may be used to refer to 2,3,22,23-diepoxy squalene or 2,3,22,23-dioxido squalene. The term "2,3-epoxysqualene" may be used interchangeably with the term "2-3-oxidosqualene." As used in this application, mogroside precursors include mogrol precursors, mogrol and mogrosides.

Examples of mogrosides include, but are not limited to, mogroside I-A1 (MIA1), mogroside IE (MIE), mogroside II-A1 (MIIA1), mogroside II-A2 (MIIA2), mogroside III-A1 (MIIIA1), mogroside II-E (MIIE), mogroside III (MIII), siamenoside I, mogroside IV, mogroside IVa, isomogroside IV, mogroside III-E (MIIIE), mogroside V, and mogroside VI. In some embodiments, the mogroside produced is siamenoside I, which may be referred to as Siam. In some embodiments, the mogroside produced is MIIIE.

In other embodiments, a mogroside is a compound of Formula 1:

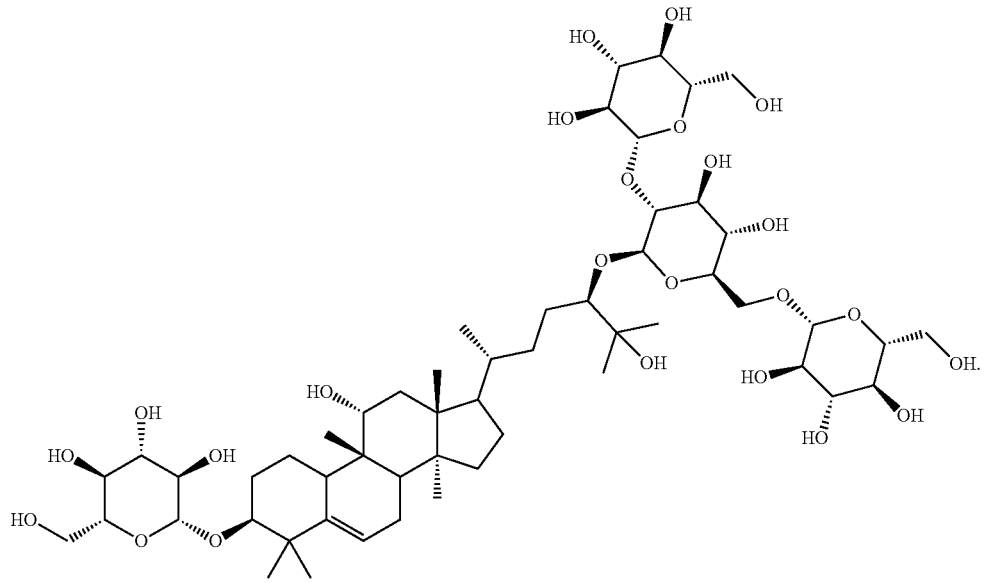 [SMILES: C[C@H](CC[C@@H](O[C@@H]1O[C@H](CO[C@@H]2O[C@H](CO)[C@@H](O)[C@H](O)[C@H]2O)[C@@H](O)[C@H](O)[C@H]1O[C@H]1O[C@@H](CO)[C@H](O)[C@@H](O)[C@@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

In some embodiments, the methods described in this application may be used to produce any of the compounds described in and incorporated by reference from US 2019/0071705, including compounds 1-20 as disclosed in US 2019/0071705. In some embodiments, the methods described in this application may be used to produce variants of any of the compounds described in and incorporated by reference from US 2019/0071705, including variants of compounds 1-20 as disclosed in US 2019/0071705. For example, a variant of a compound described in US 2019/0071705 can comprise a substitution of one or more alpha-glucosyl linkages in a compound described in US 2019/0071705 with one or more beta-glucosyl linkages. In some embodiments, a variant of a compound described in US 2019/0071705 comprises a substitution of one or more beta-glucosyl linkages in a compound described in US 2019/0071705 with one or more alpha-glucosyl linkages. In some embodiments, a variant of a compound described in US 2019/0071705 is a compound of Formula 1 shown above.

Cucurbitadienol Synthase (CDS) Enzymes

Aspects of the present disclosure provide cucurbitadienol synthase (CDS) enzymes, which may be useful, for example, in the production of a cucurbitadienol compound, such as 24-25 epoxy-cucurbitadienol or cucurbitadienol. CDSs are capable of catalyzing the formation of cucurbitadienol compounds, such as 24-25 epoxy-cucurbitadienol or cucurbitadienol from oxidosqualene (e.g., 2-3-oxidosqualene or 2,3; 22,23-diepoxysqualene).

In some embodiments, CDS enzymes have a leucine residue corresponding to position 123 of SEQ ID NO: 74 that distinguishes them from other oxidosqualene cyclases, as discussed in Takase et al. *Org. Biomol. Chem.*, 2015, 13, 7331-7336, which is incorporated by reference in its entirety.

CDSs of the present disclosure may comprise a sequence that is at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical, including all values in between, to a nucleic acid or amino acid sequence in Table 2 or to a sequence selected from SEQ ID NOs: 1-80.

In some embodiments a CDS enzyme corresponds to SEQ ID NO: 43, SEQ ID NO: 52, or SEQ ID NO: 49.

In some embodiments, a polynucleotide sequence encoding a CDS enzyme may be re-coded for expression in a particular host cell, including *S. cerevisiae*. In some embodiments, a re-coded polynucleotide sequence encoding a CDS enzyme corresponds to SEQ ID NO: 34.

In some embodiments, a polynucleotide sequence encoding a CDS is at least 90% identical to SEQ ID NOs: 3, 9, or 12. In some embodiments, a CDS is at least 90% identical to SEQ ID NOs: 43, 49, or 52.

In some embodiments, a CDS of the present disclosure is capable of using oxidosqualene (e.g., 2,3-oxidosqualene or 2,3; 22,23-diepoxysqualene) as a substrate. In some embodiments, a CDS of the present disclosure is capable of producing cucurbitadienol compounds (e.g., 24-25 epoxy-cucurbitadienol or cucurbitadienol). In some embodiments, a CDS of the present disclosure catalyzes the formation of cucurbitadienol compounds (e.g., 24-25 epoxy-cucurbitadienol or cucurbitadienol) from oxidosqualene (e.g., 2-3-oxidosqualene or 2,3; 22,23-diepoxysqualene).

It should be appreciated that activity of a CDS can be measured by any means known to one of ordinary skill in the art. In some embodiments, the activity of a CDS may be measured as the normalized peak area of cucurbitadienol produced. In some embodiments, this activity is measured in arbitrary units. In some embodiments, the activity, such as specific activity, of a CDS of the present disclosure is at least 1.1 fold (e.g., at least 1.3 fold, at least 1.5 fold, at least 1.7 fold, at least 1.9 fold, at least 2 fold, at least 2.5 fold, at least 3 fold, at least 4 fold, at least 5 fold, at least 10 fold, at least 20 fold, at least 30 fold, at least 40 fold, at least 50 fold, or at least 100 fold, including all values in between) greater than that of a control CDS.

It should be appreciated that one of ordinary skill in the art would be able to characterize a protein as a CDS enzyme based on structural and/or functional information associated with the protein. For example, in some embodiments, a protein can be characterized as a CDS enzyme based on its function, such as the ability to produce cucurbitadienol compounds (e.g., 24-25 epoxy-cucurbitadienol or cucurbitadienol) using oxidosqualene (e.g., 2,3-oxidosqualene or 2,3; 22,23-diepoxysqualene) as a substrate. In some embodiments, a protein can be characterized, at least in part, as a CDS enzyme based on the presence of a leucine residue at a position corresponding to position 123 of SEQ ID NO: 73.

In some embodiments, a CDS comprises the motif $GX_1WASDLGGP$ (SEQ ID NO: 331), wherein $X_1$ is N or H. In some embodiments, the motif $GX_1WASDLGGP$ (SEQ ID NO: 331) is located in the CDS at residues corresponding to positions 117-126 in SEQ ID NO: 73.

In some embodiments, a CDS comprises the motif $DX_1GWL$ (SEQ ID NO: 332), wherein $X_1$ is H or Q. In some embodiments, the motif $DX_1GWL$ (SEQ ID NO: 332) is located in the CDS at residues corresponding to positions 479-483 in SEQ ID NO: 73.

In some embodiments, a CDS comprises the motif CWGVCFTYAGW (SEQ ID NO: 333). In some embodiments, the motif CWGVCFTYAGW (SEQ ID NO: 333) is located in the CDS at residues corresponding to positions 612-622 in SEQ ID NO: 73.

In some embodiments, a CDS comprises the motif GHWASDLGGP (SEQ ID NO: 334). In some embodiments, the motif GHWASDLGGP (SEQ ID NO: 334) is located in the CDS at residues corresponding to positions 117-126 in SEQ ID NO: 73. In some embodiments, a CDS comprises the motif DQGWL (SEQ ID NO: 335). In some embodiments, the motif DQGWL (SEQ ID NO: 335) is located in the CDS at residues corresponding to positions 479-483 in SEQ ID NO: 73.

In some embodiments, a CDS comprises the motif GHWASDLGGP (SEQ ID NO: 334), the motif DQGWL (SEQ ID NO: 335), and/or the motif CWGVCFTYAGW (SEQ ID NO: 333).

In some embodiments, a CDS comprises a leucine at a residue corresponding to position 123 in SEQ ID NO: 73. In some embodiments, a CDS comprises a leucine at a residue corresponding to position 483 in SEQ ID NO: 73. In some embodiments, a CDS comprises a cysteine at a residue corresponding to position 612 in SEQ ID NO: 73, a glycine at a residue corresponding to position 614 in SEQ ID NO: 73, an alanine at a residue corresponding to position 620 in SEQ ID NO: 73, and/or a glycine at a residue corresponding to position 621 in SEQ ID NO: 73. In some embodiments, a CDS comprises a leucine at a residue corresponding to position 123 in SEQ ID NO: 73, a leucine at a residue corresponding to position 483 in SEQ ID NO: 73, a cysteine at a residue corresponding to position 612 in SEQ ID NO: 73, a glycine at a residue corresponding to position 614 in SEQ ID NO: 73, an alanine at a residue corresponding to position 620 in SEQ ID NO: 73, and/or a glycine at a residue corresponding to position 621 in SEQ ID NO: 73.

In some embodiments, a CDS comprises the motif GHWANDLGGP (SEQ ID NO: 336). In some embodiments, the motif GHWANDLGGP (SEQ ID NO: 336) is located in the CDS at residues corresponding to positions 117-126 in SEQ ID NO: 73.

In some embodiments, a CDS comprises the motif DX₁GWL (SEQ ID NO: 332). In some embodiments, the motif DX₁GWL (SEQ ID NO: 332) is located in the CDS at residues corresponding to positions 479-483 in SEQ ID NO: 73.

In some embodiments, a CDS comprises the motif CWGVCYTYAGW (SEQ ID NO: 337). In some embodiments, the motif CWGVCYTYAGW (SEQ ID NO: 337) is located in the CDS at residues corresponding to positions 612-622 in SEQ ID NO: 73.

In some embodiments, a CDS comprises: the motif GHWANDLGGP (SEQ ID NO: 336), located at residues corresponding to positions 117-126 in SEQ ID NO: 73; the motif DQGWL (SEQ ID NO: 335), located at residues corresponding to positions 479-483 in SEQ ID NO: 73; and/or the motif CWGVCYTYAGW (SEQ ID NO: 337), located at residues corresponding to positions 612-622 in SEQ ID NO: 73.

In some embodiments, a host cell that comprises a heterologous polynucleotide encoding a CDS enzyme produces at least 10%, 20%, 30%, 40%, 50%, 60%, 70%, 80%, 90%, or 100% more cucurbitadienol compound compared to the same host cell that does not express the heterologous gene.

In some embodiments, a host cell that comprises a heterologous polynucleotide encoding a CDS enzyme produces at least 10%, 20%, 30%, 40%, 50%, 60%, 70%, 80%, 90%, or 100% more cucurbitadienol compound relative to a control host cell, wherein the control host cell expresses *S. grosvenorii* CDS, encoded by a polynucleotide corresponding to SEQ ID NO:33.

Throughout this disclosure, host cells that express any of the heterologous polynucleotides described in this application may be compared to a control host cell. It should be appreciated that a control host cell may have the same genetic background as a host cell that is expressing a specific heterologous polynucleotide sequence, except that the control host cell would not express the same specific heterologous polynucleotide sequence.

In other embodiments, a protein can be characterized as a CDS enzyme based on the percent identity between the protein and a known CDS enzyme. For example, the protein may be at least 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, or 100% identical, including all values in between, to any of the CDS sequences described in this application or the sequence of any other CDS enzyme. In other embodiments, a protein can be characterized as a CDS enzyme based on the presence of one or more domains in the protein that are associated with CDS enzymes. For example, in certain embodiments, a protein is characterized as a CDS enzyme based on the presence of a substrate channel and/or an active-site cavity characteristic of CDS enzymes known in the art. In some embodiments, the active site cavity comprises a residue that acts a gate to this channel, helping to exclude water from the cavity. In some embodiments, the active-site comprises a residue that acts a proton donor to open the epoxide of the substrate and catalyze the cyclization process.

In other embodiments, a protein can be characterized as a CDS enzyme based on a comparison of the three-dimensional structure of the protein compared to the three-dimensional structure of a known CDS enzyme. It should be appreciated that a CDS enzyme can be a synthetic protein.

UDP-Glycosyltransferases (UGT) Enzymes

Aspects of the present disclosure provide UDP-glycosyltransferase enzymes (UGTs), which may be useful, for example, in the production of a mogroside (e.g., mogroside I-A1 (MIA1), mogroside I-E (MIE), mogroside II-A1 (MIIA1), mogroside II-A2 (MIIA2), mogroside III-A1 (MIIIA1), mogroside II-E (MIIE), mogroside III (MIII), siamenoside I, mogroside III-E (MIIIE), mogroside IV, mogroside IVa, isomogroside IV, mogroside V, or mogroside VI).

Figure 1C:
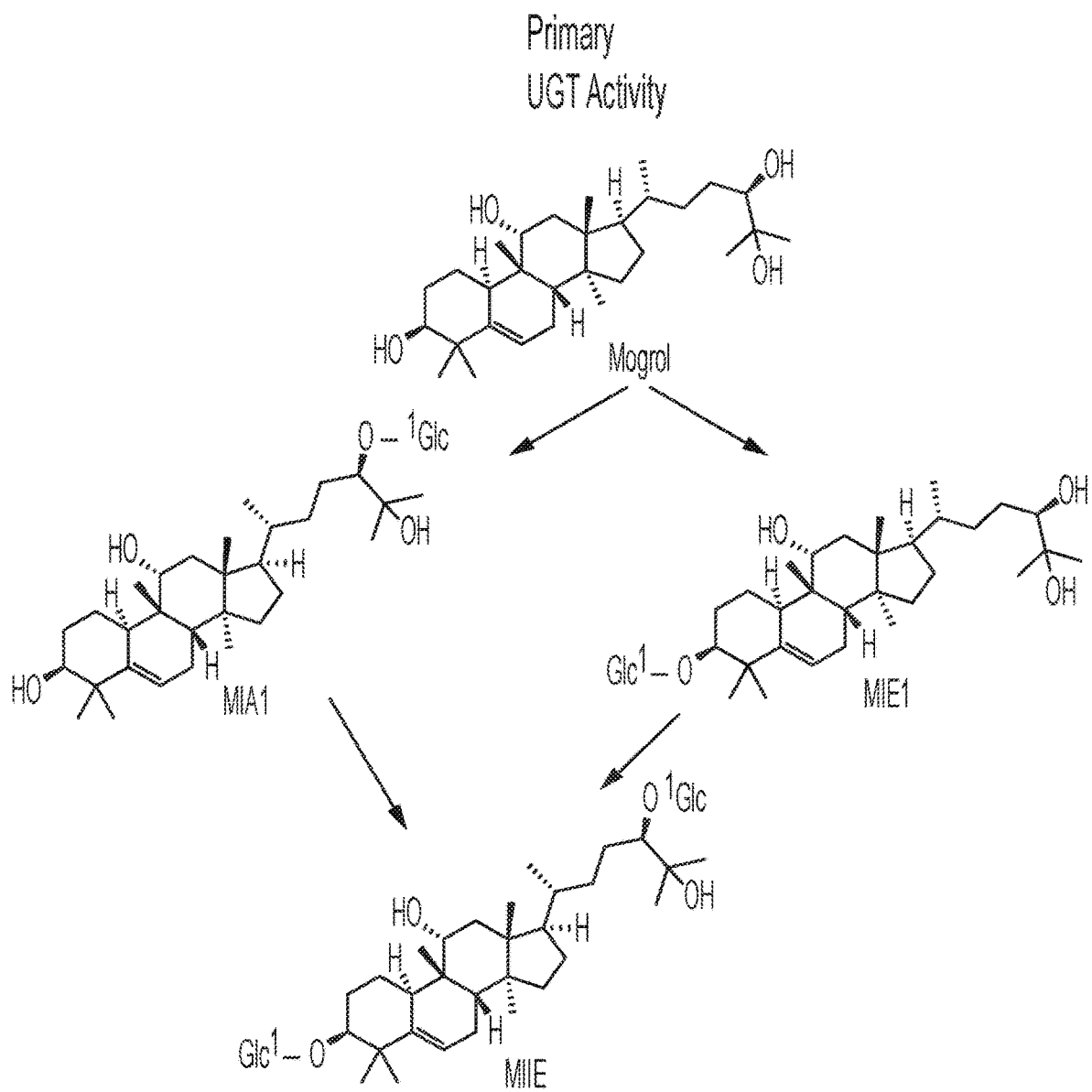
Figure 1D:
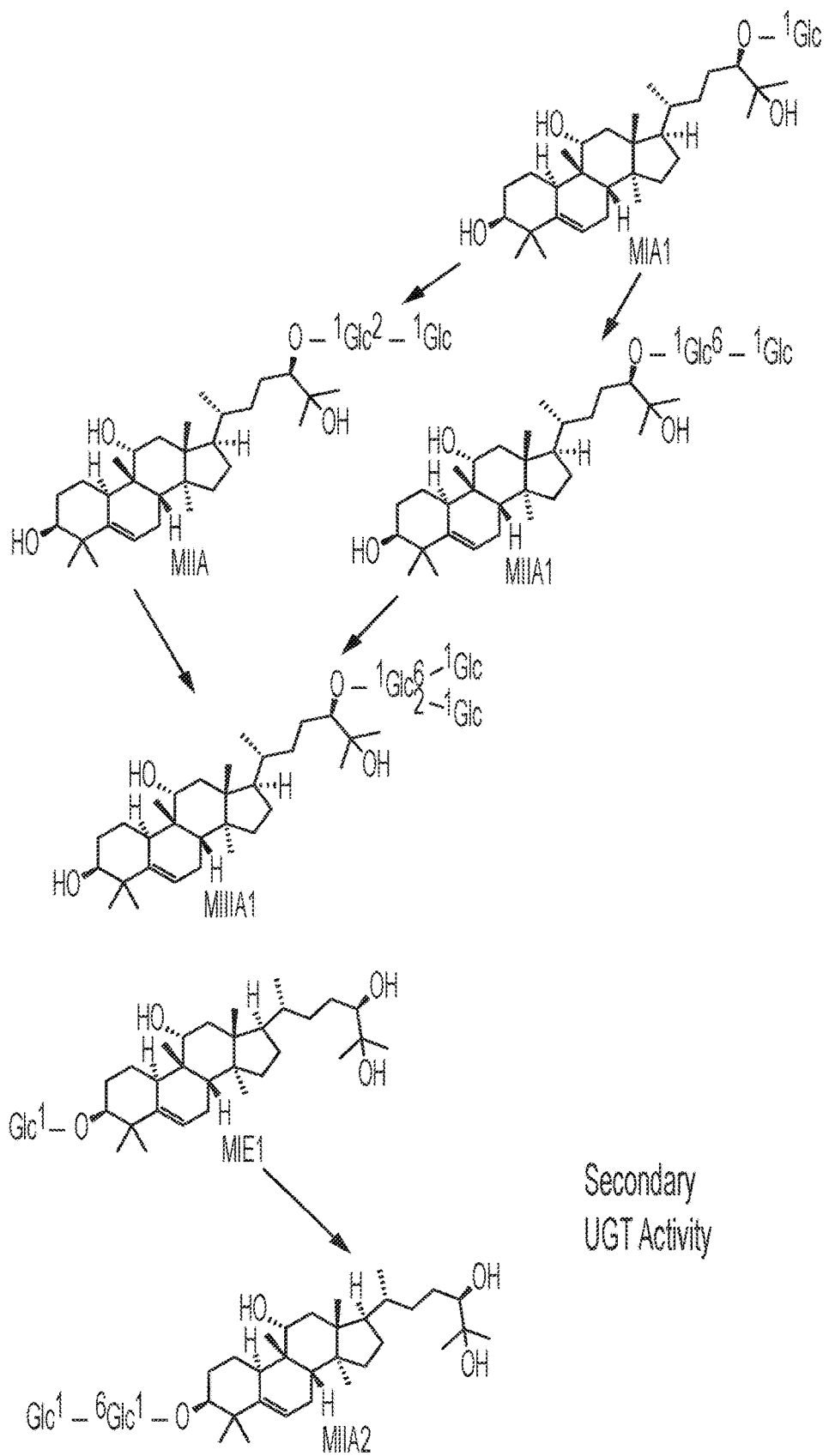

As used in this application, a "UGT" refers to an enzyme that is capable of catalyzing the addition of the glycosyl group from a UTP-sugar to a compound (e.g., mogroside or mogrol). A UGT may be a primary and/or a secondary UGT. A "primary" UGT refers to a UGT that is capable of catalyzing the addition of a glycosyl group to a position on a compound that does not comprise a glycosyl group. For example, a primary UGT may be capable of adding a glycosyl group to the C3 and/or C24 position of an isoprenoid substrate (e.g., mogrol). See, e.g., FIG. 1C. A "secondary" UGT refers to a UGT that is capable of catalyzing the addition of a glycosyl group to a position on a compound that already comprises a glycosyl group. See, e.g., FIG. 1D. As a non-limiting example, a secondary UGT may add a glycosyl group to a mogroside I-A1 (MIA1), mogroside I-E (MIE), mogroside II-A1 (MIIA1), mogroside II-A2 (MIIA2), mogroside III-A1 (MIIIA1), mogroside II-E (MIIE), mogroside III (MIII), siamenoside I, mogroside III-E (MIIIE), mogroside IV, mogroside IVa, isomogroside IV, mogroside V, and/or mogroside VI.

Structurally, UGTs often comprise a UDPGT (Prosite: PS00375) domain and a catalytic dyad. As a non-limiting example, one of ordinary skill in the art may identify a catalytic dyad in a UGT by aligning the UGT sequence to UGT94-289-1 (a wildtype UGT sequence from the monk fruit *Siraitia grosvenorii*) and identifying the two residues in the UGT that correspond to histidine 21 (H21) and aspartate 122 (D122) of UGT94-289-1.

The amino acid sequence for UGT94-289-1 is:

(SEQ ID NO: 109)
MDAQRGHTTTILMFPWLGYGHLSAFLELAKSLSRRNFHIYFCSTSVNLD

AIKPKLPSSSSSDSIQLVELCLPSSPDQLPPHLHTTNALPPHLMPTLHQ

AFSMAAQHFAAILHTLAPHLLIYDSFQPWAPQLASSLNIPAINFNTTGA

SVLTRMLHATHYPSSKFPISEFVLHDYWKAMYSAAGGAVTKKDHKIGET

LANCLHASCSVILINSFRELEEKYMDYLSVLLNKKVVPVGPLVYEPNQD

GEDEGYSSIKNWLDKKEPSSTVFVSFGSEYFPSKEEMEEIAHGLEASEV

HFIWVVRFPQGDNTSAIEDALPKGFLERVGERGMVVKGWAPQAKILKHW

STGGFVSHCGWNSVMESMMFGVPIIGVPMHLDQPFNAGLAEEAGVGVEA

KRDPDGKIQRDEVAKLIKEVVVEKTREDVRKKAREMSEILRSKGEEKMD

EMVAAISLFLKI.

A non-limiting example of a nucleic acid sequence encoding UGT94-289-1 is:

(SEQ ID NO: 93)
atggacgcgcaacgcggacatacgactaccatcctgatgtttccgtggt tggggtacggccaccttagtgcattcctcgaattagccaagagcttgtc gcgtaggaactttcatatttatttctgttccacatctgtcaatttagat gctataaaacccaaactaccatcatcttcaagttccgattctattcagc ttgtagagttatgcttgccttcctcgccagaccaactaccccacacct -continued

```
gcatacaactaatgctctacctccacatctaatgcctaccctgcaccag gccttttcaatggcagctcaacattttgcagctatattacatactttag caccgcacttgttaatctatgattcgttccagccttgggcgccacaatt ggccagctctcttaacattcctgctattaattttaataccacgggtgcc agtgtgctaacaagaatgttacacgcgactcattacccatcttcaaagt tcccaatctccgaatttgttttacatgattattggaaagcaatgtattc agcagctggtggtgctgttacaaaaaaggaccataaaataggagaaacc ttggcaaactgtttacacgcttcttgctcggtaattctgatcaattcat tcagagagttggaagaaaaatacatggattacttgtctgtcttactaaa caagaaagttgtgcccgtgggtccgcttgtttatgagccaaaccaagat ggcgaagacgaaggttatagttcgataaagaattggctcgataaaaagg agccctcctcaactgtctttgtttccttcgggtccgaatattttccgtc caaagaagaaatggaagaaattgcccatggcttggaggctagcgaggta cactttatttgggtcgttagattcccacaaggagacaatacttctgcaa ttgaagatgccctcctaagggttttcttgagcgagtgggcgaacgtgg aatggtggttaagggttgggctcctcaggccaaaattttgaaacattgg agcacaggcggtttcgtaagtcattgtggatggaatagtgttatggaga gcatgatgtttggtgtacccataataggtgttccgatgcatttagatca accatttaatgcagggctcgcggaagaagcaggagtaggggtagaggct aaaagggaccctgatggtaagatacagagagatgaagtcgctaaactga tcaaagaagtggttgtcgaaaaaacgcgcgaagatgtcagaaagaaggc tagggaaatgtctgaaattttacgttcgaaaggtgaggaaaagatggac gagatggttgcagccattagtctcttcttgaagatataa.
```

One of ordinary skill in the art would readily recognize how to determine for any UGT enzyme what amino acid residue corresponds to a specific amino acid residue in UGT94-289-1 (SEQ ID NO: 109) by, for example, aligning sequences and/or by comparing secondary or tertiary structures.

In certain embodiments, a UGT of the present disclosure comprises one or more structural motifs corresponding to a structural motif in wild-type UGT94-289-1 (e.g., corresponding to a structural motif that is shown in Table 5). In some embodiments, a UGT comprises structural motifs corresponding to all structural motifs in Table 5. In some embodiments, a UGT comprises a structural motif that corresponds to some but not all structural motifs shown in Table 5. In some embodiments, some structural motifs may diverge by having different lengths or different helicity. For example, a UGT of the present disclosure may comprise extended versions of loops 11, 16, 20, or a combination thereof in UGT94-289-1. A UGT of the present disclosure may comprise loops that have greater helicity than their counterpart in UGT94-289-1 (e.g., loops 11, 16, 20, or a combination thereof in UGT94-289-1).

In some embodiments, a UGT is a circularly permutated version of a reference UGT. In some embodiments, a UGT comprises a sequence that includes at least two motifs from Table 5 in a different order than a reference UGT. For example, if UGT94-289-1 is used as a reference UGT and comprises a first motif that is located C-terminal to a second motif, the first motif may be located N-terminal to the second motif in a circularly permutated UGT.

A UGT may comprise one or more motifs corresponding to one or more motifs selected from Loop 1, Beta Sheet 1, Loop 2, Alpha Helix 1, Loop 3, Beta Sheet 2, Loop 4, Alpha Helix 2, Loop 5, Beta Sheet 3, Loop 6, Alpha Helix 3, Loop 7, Beta Sheet 4, Loop 8, Alpha Helix 4, Loop 9, Beta Sheet 5, Loop 10, Alpha Helix 5, Loop 11, Alpha Helix 6, Loop 12, Alpha Helix 7, Loop 13, Beta Sheet 6, Loop 14, Alpha Helix 8, and Loop 15 from Table 5 located C-terminal to one or more motifs corresponding to one or more motifs selected from Beta Sheet 7, Loop 16, Alpha Helix 9, Loop 17, Beta Sheet 8, Loop 18, Alpha Helix 10, Loop 19, Beta Sheet 9, Alpha Helix 11, Loop 20, Alpha Helix 12, Loop 21, Beta Sheet 10, Loop 22, Alpha Helix 13, Loop 23, Beta Sheet 11, Loop 24, Alpha Helix 14, Loop 25, Beta Sheet 12, Loop 26, Alpha Helix 15, Loop 27, Beta Sheet 13, Loop 28, Alpha Helix 16, Loop 29, Alpha Helix 17, Loop 30, Alpha Helix 18, and Loop 31 in Table 5.

In some embodiments, the N-terminal portion of a UGT comprises a catalytic site, including a catalytic dyad, and/or a substrate-binding site. In some embodiments, the C-terminal portion of a UGT comprises a cofactor-binding site. For example, the N-terminal portion of UGT94-289-1 comprises a catalytic dyad corresponding to residues 21 and 122 of wildtype UGT94-289-1 (e.g., histidine 21 and aspartate acid 122). The C-terminal portion of UGT94-289-1 comprises a cofactor-binding site.

Aspects of the disclosure include UGTs that have been circularly permutated. In some embodiments, in a circularly permutated version of a UGT, the N-terminal portion and the C-terminal portions may be reversed in whole or in part. For example, the C-terminal portion of a circularly permutated UGT may comprise a catalytic site, including a catalytic dyad, and/or a substrate-binding site, while the N-terminal portion may comprise a cofactor-binding site.

In some embodiments, a circularly permutated version of a UGT comprises a heterologous polynucleotide encoding a UGT, wherein the UGT comprises: a catalytic dyad and a cofactor binding site, wherein the catalytic dyad is located C-terminal to the cofactor-binding site.

A circularly permutated UGT encompassed by the disclosure may exhibit different properties from the same UGT that has not undergone circular permutation. In some embodiments, a host cell expressing such a circularly permutated version of a UGT produces in the presence of at least one mogroside precursor at least 10%, 20%, 30%, 40%, 50%, 60%, 70%, 80%, 90%, or 100% more of one or more mogrosides relative to a host cell that comprises a heterologous polynucleotide encoding a reference UGT that is not circularly permutated, such as wild-type UGT94-289-1 (SEQ ID NO: 109). In some embodiments, a host cell expressing such a circularly permutated version of a UGT produces in the presence of at least one mogroside precursor at least 10%, 20%, 30%, 40%, 50%, 60%, 70%, 80%, 90%, or 100% less of one or more mogrosides relative to a host cell that comprises a heterologous polynucleotide encoding a reference UGT that is not circularly permutated, such as wild-type UGT94-289-1 (SEQ ID NO: 109).

In some embodiments, in a circularly permutated version of a UGT, the N-terminal portion of a UGT comprises residues that are usually present in the C-terminal portion of a UGT, such as UGT94-289-1. In some embodiments, in a circularly permutated version of a UGT, the C-terminal portion of a UGT comprises residues that are usually present in the N-terminal portion of a UGT, such as UGT94-289-1.

In some embodiments, the N-terminal portion of a UGT, such as UGT94-289-1, corresponds to approximately residues 2-122, residues 2-123, residues 2-124, residues 2-125, residues 2-126, residues 2-127, residues 2-128, residues 2-129, residues 2-130, residues 2-131, residues 2-132, residues 2-133, residues 2-134, residues 2-135, residues 2-136, residues 2-137, residues 2-138, residues 2-139, residues 2-140, residues 2-141, residues 2-142, residues 2-143, residues 2-144, residues 2-145, residues 2-146, residues 2-147, residues 2-148, residues 2-149, residues 2-150, residues 2-151, residues 2-152, residues 2-153, residues 2-154, residues 2-155, residues 2-156, residues 2-157, residues 2-158, residues 2-159, residues 2-160, residues 2-161, residues 2-162, residues 2-163, residues 2-164, residues 2-165, residues 2-166, residues 2-167, residues 2-168, residues 2-169, residues 2-170, residues 2-171, residues 2-172, residues 2-173, residues 2-174, residues 2-175, residues 2-176, residues 2-177, residues 2-178, residues 2-179, residues 2-180, residues 2-181, residues 2-182, residues 2-183, residues 2-184, residues 2-185, residues 2-186, residues 2-187, residues 2-188, residues 2-189, residues 2-190, residues 2-191, residues 2-192, residues 2-193, residues 2-194, residues 2-195, residues 2-196, residues 2-197, residues 2-198, residues 2-199, residues 2-200, residues 2-201, residues 2-202, residues 2-203, residues 2-204, residues 2-205, residues 2-206, residues 2-207, residues 2-208, residues 2-209, residues 2-210, residues 2-211, residues 2-212, residues 2-213, residues 2-214, residues 2-215, residues 2-216, residues 2-217, residues 2-218, residues 2-219, residues 2-220, residues 2-221, residues 2-222, residues 2-223, residues 2-224, residues 2-225, residues 2-226, residues 2-227, residues 2-228, residues 2-229, residues 2-230, residues 2-231, residues 2-232, residues 2-233, residues 2-234, residues 2-235, residues 2-236, residues 2-237, residues 2-238, residues 2-239, residues 2-240, residues 2-241, residues 2-242, residues 2-243, residues 2-244, residues 2-245, residues 2-246, residues 2-247, residues 2-248, residues 2-249, residues 2-250, residues 2-251, or residues 2-252 of a UGT, such as UGT94-289-1 (SEQ ID NO: 109), or corresponding residues in another UGT.

In some embodiments, the C-terminal domain of a UGT, such as UGT94-289-1, corresponds to approximately residues 123-456, residues 124-456, residues 125-456, residues 126-456, residues 127-456, residues 128-456, residues 129-456, residues 130-456, residues 131-456, residues 132-456, residues 133-456, residues 134-456, residues 135-456, residues 136-456, residues 137-456, residues 138-456, residues 139-456, residues 140-456, residues 141-456, residues 142-456, residues 143-456, residues 144-456, residues 145-456, residues 146-456, residues 147-456, residues 148-456, residues 149-456, residues 150-456, residues 151-456, residues 152-456, residues 153-456, residues 154-456, residues 155-456, residues 156-456, residues 157-456, residues 158-456, residues 159-456, residues 160-456, residues 161-456, residues 162-456, residues 163-456, residues 164-456, residues 165-456, residues 166-456, residues 167-456, residues 168-456, residues 169-456, residues 170-456, residues 171-456, residues 172-456, residues 173-456, residues 174-456, residues 175-456, residues 176-456, residues 177-456, residues 178-456, residues 179-456, residues 180-456, residues 181-456, residues 182-456, residues 183-456, residues 184-456, residues 185-456, residues 186-456, residues 187-456, residues 188-456, residues 189-456, residues 190-456, residues 191-456, residues 192-456, residues 193-456, residues 194-456, residues 195-456, residues 196-456, residues 197-456, residues 198-456, residues 199-456, residues 200-456, residues 201-456, residues 202-456, residues 203-456, residues 204-456, residues 205-456, residues 206-456, residues 207-456, residues 208-456, residues 209-456, residues 210-456, residues 211-456, residues 212-456, residues 213-456, residues 214-456, residues 215-456, residues 216-456, residues 217-456, residues 218-456, residues 219-456, residues 220-456, residues 221-456, residues 222-456, residues 223-456, residues 224-456, residues 225-456, residues 226-456, residues 227-456, residues 228-456, residues 229-456, residues 230-456, residues 231-456, residues 232-456, residues 233-456, residues 234-456, residues 235-456, residues 236-456, residues 237-456, residues 238-456, residues 239-456, residues 240-456, residues 241-456, residues 242-456, residues 243-456, residues 244-456, residues 245-456, residues 246-456, residues 247-456, residues 248-456, residues 249-456, residues 250-456, or residues 251-456 of a UGT, such as UGT94-289-1 (SEQ ID NO: 109), or corresponding residues in another UGT.

In some embodiments, a UGT of the present disclosure comprises a sequence (e.g., nucleic acid or amino acid sequence) that is at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical, including all values in between, to a sequence in Tables 3, 6 or 7, to a sequence selected from SEQ ID NOs: 207-242, SEQ ID NOs: 243-316, SEQ ID NOs: 225-242, SEQ ID NOs: 280-316, SEQ ID NOs: 317-322, SEQ ID NOs: 323-328, or SEQ ID NO: 330 or to any of the UGTs disclosed in this application.

In some embodiments, a UGT of the present disclosure may comprise an amino acid substitution at an amino acid residue corresponding to an amino acid residue in wild-type UGT94-289-1 (SEQ ID NO: 109). For example, an amino acid residue that contains a substitution can be an amino acid that corresponds to an amino acid residue in wild-type UGT94-289-1 (SEQ ID NO: 109) selected from, e.g., S123; F124; N143; T144; T145; V149; Y179; G18; S180; A181; G184; A185; V186; T187; K189; Y19; H191; K192; G194; E195; A198; F276; N355; H373; L374; N47; H83; T84; T85; N86; P89; and/or L92. Non-limiting examples of such amino acid substitutions include: S123 may be mutated to alanine, cysteine, glycine or valine, or to any conservative substitution of alanine, cysteine, glycine or valine; F124 may be mutated to tyrosine or to any conservative substitution of tyrosine; N143 may be mutated to alanine, cysteine, glutamate, isoleucine, leucine, methionine, glutamine, serine, threonine or valine, or to any conservative substitution of alanine, cysteine, glutamate, isoleucine, leucine, methionine, glutamine, serine, threonine or valine; T144 may be mutated to alanine, cysteine, asparagine or proline, or to any conservative substitution of alanine, cysteine, asparagine or proline; T145 may be mutated to alanine, cysteine, glycine, methionine, asparagine, glutamine, or serine, or any conservative substitution of alanine, cysteine, glycine, methionine, asparagine, glutamine, or serine; V149 may be mutated to cysteine, leucine or methionine, or to any conservative substitution of cysteine, leucine or methionine; Y179 may be mutated to glutamate, phenylalanine, histidine, isoleucine, lysine, leucine, valine, or tryptophan, or to any conservative substitution glutamate, phenylalanine, histidine, isoleucine, lysine, leucine, valine, or tryptophan; G18 may be mutated to serine or to any conservative substitution of serine; S180 may be mutated to alanine or valine, or to any conservative substitution of alanine or valine; A181 may be mutated to lysine or threonine, or to any conservative substitution of lysine or threonine; G184 may be mutated to alanine, cysteine, aspartate, glutamate, phenylalanine, histidine, isoleucine, lysine, methionine, asparagine, proline, glutamine, arginine, serine, threonine, or tyrosine, or to any conservative substitution of alanine, cysteine, aspartate, glutamate, phenylalanine, histidine, isoleucine, lysine, methionine, asparagine, proline, glutamine, arginine, serine, threonine, or tyrosine; A185 may be mutated to cysteine, aspartate, glutamate, glycine, lysine, leucine, methionine, asparagine, proline, glutamine, threonine, tryptophan or tyrosine, or to any conservative substitution of cysteine, aspartate, glutamate, glycine, lysine, leucine, methionine, asparagine, proline, glutamine, threonine, tryptophan or tyrosine; V186 may be mutated to alanine, cysteine, aspartate, glutamate, glycine, isoleucine, lysine, leucine, methionine, asparagine, proline, glutamine, arginine, threonine, tryptophan, or tyrosine, or to any conservative substitution of alanine, cysteine, aspartate, glutamate, glycine, isoleucine, lysine, leucine, methionine, asparagine, proline, glutamine, arginine, threonine, tryptophan, or tyrosine; T187 may be mutated to alanine, cysteine, aspartate, glutamate, glycine, histidine, isoleucine, lysine, leucine, asparagine, proline, arginine, serine, valine, tryptophan, or tyrosine, or to any conservative substitution of alanine, cysteine, aspartate, glutamate, glycine, histidine, isoleucine, lysine, leucine, asparagine, proline, arginine, serine, valine, tryptophan, or tyrosine; K189 may be mutated to alanine, cysteine, aspartate, glutamate, phenylalanine, glycine, histidine, isoleucine, leucine, methionine, proline, glutamine, arginine, serine, threonine, valine, tryptophan, or tyrosine, or to any conservative substitution thereof of alanine, cysteine, aspartate, glutamate, phenylalanine, glycine, histidine, isoleucine, leucine, methionine, proline, glutamine, arginine, serine, threonine, valine, tryptophan, or tyrosine; Y19 may be mutated to phenylalanine, histidine, leucine, or valine, or to any conservative substitution of phenylalanine, histidine, leucine, or valine; H191 may be mutated to alanine, cysteine, aspartate, glutamate, glycine, lysine, methionine, proline, glutamine, serine, threonine, valine, tryptophan, or tyrosine, or to any conservative substitution of mutated to alanine, cysteine, aspartate, glutamate, glycine, lysine, methionine, proline, glutamine, serine, threonine, valine, tryptophan, or tyrosine; K192 may be mutated to cysteine or phenylalanine, or to any conservative substitution of cysteine or phenylalanine; G194 may be mutated to aspartate, leucine, methionine, asparagine, proline, serine, or tryptophan, or to any conservative substitution of aspartate, leucine, methionine, asparagine, proline, serine, or tryptophan; E195 may be mutated to alanine, isoleucine, lysine, leucine, asparagine, glutamine, serine, threonine, or tyrosine, or to any conservative substitution of alanine, isoleucine, lysine, leucine, asparagine, glutamine, serine, threonine, or tyrosine; A198 may be mutated to cysteine, aspartate, glutamate, phenylalanine, histidine, isoleucine, lysine, leucine, methionine, asparagine, proline, glutamine, arginine, serine, threonine, valine, or tyrosine, or to any conservative substitution of cysteine, aspartate, glutamate, phenylalanine, histidine, isoleucine, lysine, leucine, methionine, asparagine, proline, glutamine, arginine, serine, threonine, valine, or tyrosine; F276 may be mutated to cysteine or glutamine, or to any conservative substitution of cysteine or glutamine; N355 may be mutated to glutamine or serine, or any conservative substitution thereof; H373 may be mutated to lysine, leucine, methionine, arginine, valine, or tyrosine, or to any conservative substitution of lysine, leucine, methionine, arginine, valine, or tyrosine; L374 may be mutated to alanine, cysteine, phenylalanine, histidine, methionine, asparagine, glutamine, serine, threonine, valine, tryptophan, or tyrosine, or to any conservative substitution of alanine, cysteine, phenylalanine, histidine, methionine, asparagine, glutamine, serine, threonine, valine, tryptophan, or tyrosine; N47 may be mutated to glycine or to any conservative substitution of glycine; H83 may be mutated to glutamine or tryptophan, or to any conservative substitution of glutamine or tryptophan; T84 may be mutated to tyrosine or to any conservative substitution of tyrosine; T85 may be mutated to glycine, lysine, proline, serine, or tyrosine, or to any conservative substitution of glycine, lysine, proline, serine, or tyrosine; N86 may be mutated to alanine, cysteine, glutamate, isoleucine, lysine, leucine, serine, tryptophan, or tyrosine, or to any conservative substitution of alanine, cysteine, glutamate, isoleucine, lysine, leucine, serine, tryptophan, or tyrosine; P89 may be mutated to methionine or serine or to any conservative substitution of methionine or serine; and/or L92 may be mutated to histidine or lysine or to any conservative substitution of histidine or lysine.

One of ordinary skill in the art would readily recognize how to determine for any UGT enzyme what amino acid residue corresponds to a specific amino acid residue in UGT94-289-1 (SEQ ID NO: 109) by, for example, aligning sequences and/or by comparing secondary structures. As a non-limiting example, a sequence alignment (e.g., conducted using Clustal Omega, see e.g., Larkin et al., Bioinformatics. 2007 Nov. 1; 23(21):2947-8) is provided in FIG. 9 between UGT94-289-1 (SEQ ID NO: 109) and U73C6 (SEQ ID NO: 103). For example, in FIG. 9, the residue in U73C6 (SEQ ID NO: 103) corresponding to position 123 in UGT94-289-1 (SEQ ID NO: 109) is methionine (M). As another non-limiting example, the residue in U73C6 (SEQ ID NO: 103) corresponding to position 143 in UGT94-289-1 (SEQ ID NO: 109) is histidine (H) (FIG. 9). As another non-limiting example, the residue in U73C6 (SEQ ID NO: 103) corresponding to position 273 in UGT94-289-1 (SEQ ID NO: 109) is phenylalanine (F) (FIG. 9).

In some embodiments, a UGT comprises an amino acid substitution corresponding to the amino acid substitutions in UGT94-289-1 set forth in Table 4.

A UGT of the present disclosure can comprise a conservative amino acid substitution and/or a non-conservative amino acid substitution. In some embodiments, a UGT of the present disclosure comprises 1, 2, 3, 4, 5, 6, 7, 8, 9, 10 or more than 10 conservative amino acid substitution(s). In some embodiments, a UGT of the present disclosure comprises 1, 2, 3, 4, 5, 6, 7, 8, 9, 10 or more than 10 non-conservative amino acid substitutions. In some embodiments, a conservative or non-conservative amino acid substitution is not located in a conserved region of a UGT protein. In some embodiments, a conservative or non-conservative amino acid substitution is not located in a region corresponding to: residues 83 to 92; residues 179 to 198; residue N143; residue L374; residue H21; or residue D122 of wild-type UGT94-289-1. One of ordinary skill in the art would readily be able to test a UGT that comprises a conservative and/or non-conservative substitution to determine whether the conservative and/or non-conservative substitution impacts the activity or function of the UGT.

In some embodiments, a UGT enzyme contains an amino acid substitution located within 10 angstrom, 9 angstrom 8 angstrom, 7 angstrom, 6 angstrom, 5 angstrom, 4 angstrom, 3 angstrom, 2 angstrom, or within 1 angstrom (including all values in between) of a catalytic dyad. The catalytic dyad may correspond to residues 21 and 122 of wildtype UGT94-289-1 (e.g., histidine 21 and aspartate acid 122). It should be appreciated that one of ordinary skill in the art would readily recognize how to determine to corresponding location of the catalytic dyad in any UGT enzyme, for example, by aligning the sequence and/or by comparing the secondary structure with UGT94-289-1 (SEQ ID NO: 109).

In some embodiments, a UGT enzyme contains an amino acid substitution at an amino acid residue located in one or more structural motifs of the UGT. Non-limiting examples of secondary structures in UGTs, such as UGT94-289-1 (SEQ ID NO: 109), include: the loop between beta sheet 4 and alpha helix 5; beta sheet 5; the loop between beta sheet 5 and alpha helix 6; alpha helix 6; the loop between alpha helix 6 & 7; the loop between beta sheet 1 & alpha helix 1; alpha helix 7; the loop between alpha helix 7 & 8; alpha helix 1; alpha helix 8; the loop between beta sheet 8 & alpha helix 13; alpha helix 17; the loop between beta sheet 12 & alpha helix 18; alpha helix 2; loop between beta sheet 3 & alpha helix 3; alpha helix 3; and the loop between alpha helix 3 & 4; loop 8; beta sheet 5; loop 10; alpha helix 5; loop 11; loop 2; alpha helix 6; loop 12; alpha helix 1; alpha helix 7; loop 18; alpha helix 14; loop 26; alpha helix 2; loop 6; and alpha helix 3.

In some embodiments: the amino acid residue located in loop 8 is a residue corresponding to S123 or F124 in UGT94-289-1 (SEQ ID NO: 109); the amino acid residue located in beta sheet 5 is a residue corresponding to N143 in UGT94-289-1 (SEQ ID NO: 109); the amino acid residue located in loop 10 is a residue corresponding to T144 or T145 in UGT94-289-1 (SEQ ID NO: 109); the amino acid residue located in alpha helix 5 is a residue corresponding to V149 in UGT94-289-1 (SEQ ID NO: 109); the amino acid residue located in loop 11 is a residue corresponding to Y179 in UGT94-289-1 (SEQ ID NO: 109); the amino acid residue located in loop 2 is a residue corresponding to G18 in UGT94-289-1 (SEQ ID NO: 109); the amino acid residue located in alpha helix 6 is a residue corresponding to S180 or A181 in UGT94-289-1 (SEQ ID NO: 109); the amino acid residue located in loop 12 is a residue corresponding to G184, A185, V186, T187, or K189 in UGT94-289-1 (SEQ ID NO: 109); the amino acid residue located in alpha helix 1 is a residue corresponding to Y19 in UGT94-289-1 (SEQ ID NO: 109); the amino acid residue located in alpha helix 7 is a residue corresponding to H191, K192, G194, E195, or A198 in UGT94-289-1 (SEQ ID NO: 109); the amino acid residue located in loop 18 is a residue corresponding to F276 in UGT94-289-1 (SEQ ID NO: 109); the amino acid residue located in alpha helix 14 is a residue corresponding to N355 in UGT94-289-1 (SEQ ID NO: 109); the amino acid residue located in loop 26 is a residue corresponding to H373 or L374 in UGT94-289-1 (SEQ ID NO: 109); the amino acid residue located in alpha helix 2 is a residue corresponding to N47 in UGT94-289-1 (SEQ ID NO: 109); the amino acid residue located in loop 6 is a residue corresponding to H83, T84, T85, or N86 in UGT94-289-1 (SEQ ID NO: 109); and/or the amino acid residue located in alpha helix 3 is a residue corresponding to P89 or L92 in UGT94-289-1 (SEQ ID NO: 109).

In some embodiments, a UGT comprises an amino acid substitution (e.g., at least 1, 2, 3, 4, 5, 6, 7, or 8 substitutions) in a region corresponding to residues 83 to 92, 179 to 189, 1 to 82, 93 to 142, 144 to 178, 199 to 373, or 375 to 453 of UGT94-289-1 (SEQ ID NO: 109). In some embodiments, the UGT comprises an amino acid substitution at an amino acid residue corresponding to the amino acid residue in wild-type UGT94-289-1 (SEQ ID NO: 109) selected from: N143 and L374. In some embodiments, the residue corresponding to N143 is mutated to a negatively charged R group, a polar uncharged R group, or a nonpolar aliphatic R group. In some embodiments, the residue corresponding to L374 is mutated to a nonpolar aliphatic R group, a positively charged R group, a polar uncharged R group, or a nonpolar aromatic R group. In some embodiments, a UGT comprises a region that is at least 90% identical to residues 83 to 92 of UGT94-289-1 or at least 95% identical to residues 179 to 198 of UGT94-289-1. A UGT can comprise a region that is at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least 99% identical, or is 100% identical, to residues 83 to 92 of UGT94-289-1. A UGT can comprise a region that is at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least 99% identical, or is 100% identical, to residues 179 to 198 of UGT94-289-1 (SEQ ID NO: 109).

In some embodiments, a host cell comprises a heterologous polynucleotide encoding a UGT, wherein the UGT comprises a region that: corresponds to residues 83 to 92 of wild-type UGT94-289-1 (SEQ ID NO: 109), wherein the region comprises an amino acid substitution relative to residues 83 to 92 of wild-type UGT94-289-1 (SEQ ID NO: 109); and/or corresponds to residues 179 to 198 of wild-type UGT94-289-1 (SEQ ID NO: 109), wherein the region comprises an amino acid substitution relative to residues 179 to 198 of wild-type UGT94-289-1 (SEQ ID NO: 109). It should be appreciated that the language "an amino acid substitution" is not limited to one amino acid substitution, but also encompasses embodiments including more than one amino acid substitution. In some embodiments, a host cell comprises a heterologous polynucleotide encoding a UGT, wherein the UGT comprises a region that: corresponds to residues 83 to 92 of wild-type UGT94-289-1 (SEQ ID NO: 109), wherein the region comprises no more than one amino acid substitution relative to residues 83 to 92 of wild-type UGT94-289-1 (SEQ ID NO: 109); and/or corresponds to residues 179 to 198 of wild-type UGT94-289-1 (SEQ ID NO: 109), wherein the region comprises no more than one amino acid substitution relative to residues 179 to 198 of wild-type UGT94-289-1 (SEQ ID NO: 109).

In some embodiments, the UGT comprises an amino acid substitution at an amino acid residue corresponding to the amino acid residue in wild-type UGT94-289-1 (SEQ ID NO: 109) selected from: H83, T84, T85, N86, P89, L92, Y179, S180, A181, G184, A185, V186, T187, K189, H191, K192, G194, E195, or A198.

In some embodiments, the residue corresponding to H83 is mutated to an amino acid comprising a polar uncharged R group or a nonpolar aromatic R group; the residue corresponding to T84 is mutated to an amino acid comprising a nonpolar aromatic R group; the residue corresponding to T85 is mutated to an amino acid comprising a nonpolar aliphatic R group, a positively charged R group, a polar uncharged R group, or a nonpolar aromatic R group; the residue corresponding to N86 is mutated to an amino acid comprising a nonpolar aliphatic R group, a polar uncharged R group, a negatively charged R group, a positively charged R group, or a nonpolar aromatic R group; the residue corresponding to P89 is mutated to an amino acid comprising a nonpolar aliphatic R group, or a polar uncharged R group; the residue corresponding to L92 is mutated to an amino acid comprising a positively charged R group; the residue corresponding to Y179 is mutated to an amino acid comprising a negatively charged R group, a nonpolar aromatic R group, a positively charged R group, or a nonpolar aliphatic R group; the residue corresponding to S180 is mutated to an amino acid comprising a nonpolar aliphatic R group; the residue corresponding to A181 is mutated to an amino acid comprising a positively charged R group or a polar uncharged R group; the residue corresponding to G184 is mutated to an amino acid comprising a nonpolar aliphatic R group, a polar uncharged R group, a negatively charged R group, a nonpolar aromatic R group, or a positively charged R group; the residue corresponding to A185 is mutated to an amino acid comprising a polar uncharged R group, a negatively charged R group, a nonpolar aliphatic R group, a positively charged R group, or a nonpolar aromatic R group; the residue corresponding to V186 is mutated to an amino acid comprising a nonpolar aliphatic R group, a polar uncharged R group, a negatively charged R group, a positively charged R group, or a nonpolar aromatic R group; the residue corresponding to T187 is mutated to an amino acid comprising a nonpolar aliphatic R group, a polar uncharged R group, a negatively charged R group, a positively charged R group, or a nonpolar aromatic R group; the residue corresponding to K189 is mutated to an amino acid comprising a nonpolar aliphatic R group, a polar uncharged R group, a negatively charged R group, a nonpolar aromatic R group, or a positively charged R group; the residue corresponding to H191 is mutated to an amino acid comprising a nonpolar aliphatic R group, a polar uncharged R group, a negatively charged R group, a positively charged R group, or a nonpolar aromatic R group; the residue corresponding to K192 is mutated to an amino acid comprising a polar uncharged R group or a nonpolar aromatic R group; the residue corresponding to G194 is mutated to an amino acid comprising a negatively charged R group, a nonpolar aliphatic R group, a polar uncharged R group, or a nonpolar aromatic R group; the residue corresponding to E195 is mutated to an amino acid comprising a nonpolar aliphatic R group, a positively charged R group, a polar uncharged R group, or a nonpolar aromatic R group; and/or the residue corresponding to A198 is mutated to an amino acid comprising a polar uncharged R group, a negatively charged R group, a nonpolar aromatic R group, a positively charged R group, or a nonpolar aliphatic R group.

In some embodiments, the UGT comprises an amino acid substitution at an amino acid residue corresponding to the amino acid residue in wild-type UGT94-289-1 (SEQ ID NO: 109) selected from: N143 and L374. In some embodiments, the residue corresponding to N143 is mutated to a negatively charged R group, a polar uncharged R group, or a nonpolar aliphatic R group. In some embodiments, the residue corresponding to L374 is mutated to a nonpolar aliphatic R group, a positively charged R group, a polar uncharged R group, or a nonpolar aromatic R group.

The UGTs of the present disclosure may be capable of glycosylating mogrol or a mogroside at any of the oxygenated sites (e.g., at C3, C11, C24, and C25). In some embodiments, the UGT is capable of branching glycosylation (e.g., branching glycosylation of a mogroside at C3 or C24).

Non-limiting examples of suitable substrates for the UGTs of the present disclosure include mogrol and mogrosides (e.g., mogroside IA1 (MIA1), mogroside IE (MIE), mogroside II-A1 (MIIA1), mogroside III-A1 (MIIIA1), mogroside II-E (MIIE), mogroside III (MIII), or mogroside III-E (MIIIE), siamenoside I).

In some embodiments, the UGTs of the present disclosure are capable of producing mogroside IA1 (MIA1), mogroside IE (MIE), mogroside II-A1 (MIIA1), mogroside II-A2 (MIIA2), mogroside III-A1 (MIIIA1), mogroside II-E (MIIE), mogroside III (MIII), siamenoside I, mogroside III-E (MIIIE), mogroside IV, mogroside IVa, isomogroside IV, and/or mogroside V.

In some embodiments, the UGT is capable of catalyzing the conversion of mogrol to MIA1; mogrol to MIE1; MIA1 to MIIA1; MIE1 to MIIE; MIIA1 to MIIIA1; MIA1 to MIIE; MIIA1 to MIII; MIIIA1 to siamenoside I; MIIE to MIII; MIII to siamenoside I; MIIE to MIIE; and/or MIIIE to siamenoside I.

It should be appreciated that activity, such as specific activity, of a UGT can be measured by any means known to one of ordinary skill in the art. In some embodiments, the activity, such as specific activity, of a UGT (e.g., a variant UGT) may be determined by measuring the amount of glycosylated mogroside produced per unit enzyme per unit time. For example, the activity, such as specific activity, may be measured in mmol glycosylated mogroside target produced per gram of enzyme per hour. A non-limiting example of a method to measure activity (e.g., specific activity) is provided in the Examples below. In some embodiments, a UGT of the present disclosure (e.g., variant UGT) may have an activity, such as specific activity, of at least 0.1 mmol (e.g., at least 1 mmol, at least 1.5 mmol, at least 2 mmol, at least 2.5 mmol, at least 3, at least 3.5 mmol, at least 4 mmol, at least 4.5 mmol, at least 5 mmol, at least 10 mmol, including all values in between) glycosylated mogroside target produced per gram of enzyme per hour.

In some embodiments, the activity, such as specific activity, of a UGT of the present disclosure is at least 1.1 fold (e.g., at least 1.3 fold, at least 1.5 fold, at least 1.7 fold, at least 1.9 fold, at least 2 fold, at least 2.5 fold, at least 3 fold, at least 4 fold, at least 5 fold, at least 10 fold, at least 20 fold, at least 30 fold, at least 40 fold, at least 50 fold, or at least 100 fold, including all values in between) greater than that of a control UGT. In some embodiments, the control UGT is UGT94-289-1 (SEQ ID NO: 109). In some embodiments, for a UGT that has an amino acid substitution, a control UGT is the same UGT but without the amino acid substitution.

It should be appreciated that one of ordinary skill in the art would be able to characterize a protein as a UGT enzyme based on structural and/or functional information associated with the protein. For example, a protein can be characterized as a UGT enzyme based on its function, such as the ability to produce one or more mogrosides in the presence of a mogroside precursor, such as mogrol.

In other embodiments, a protein can be characterized as a UGT enzyme based on the percent identity between the protein and a known UGT enzyme. For example, the protein may be at least 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, or 100% identical, including all values in between, to any of the UGT sequences described in this application or the sequence of any other UGT enzyme. In other embodiments, a protein can be characterized as a UGT enzyme based on the presence of one or more domains in the protein that are associated with UGT enzymes. For example, in certain embodiments, a protein is characterized as a UGT enzyme based on the presence of a sugar binding domain and/or a catalytic domain, characteristic of UGT enzymes known in the art. In certain embodiments, the catalytic domain binds the substrate to be glycosylated.

In other embodiments, a protein can be characterized as a UGT enzyme based on a comparison of the three-dimensional structure of the protein compared to the three-dimensional structure of a known UGT enzyme. For example, a protein could be characterized as a UGT based on the number or position of alpha helical domains, beta-sheet domains, etc. It should be appreciated that a UGT enzyme can be a synthetic protein.

In some embodiments, the UGT does not comprise the sequence of SEQ ID NO: 109. In some embodiments, a UGT comprises less than 95%, less than 94%, less than 93%, less than 92%, less than 91%, less than 90%, less than 89%, less than 88%, less than 87%, less than 86%, less than 85%, less than 84%, less than 83%, less than 82%, less than 81%, less than 80%, less than 79%, less than 78%, less than 77%, less than 76%, less than 75%, less than 74%, less than 73%, less than 72%, less than 71%, or less than 70% identity to SEQ ID NO: 109.

C11 Hydroxylase Enzymes

Aspects of the present disclosure provide C11 hydroxylase enzymes, which may be useful, for example, in the production of mogrol.

A C11 hydroxylase of the present disclosure may comprise a sequence that is at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or at least 100% identical, including all values in between, with a C11 hydroxylase sequence (e.g., nucleic acid or amino acid sequence) in Table 8, with a sequence set forth as SEQ ID NOs: 113, 114, 129, or 130, or to any C11 hydroxylase sequence disclosed in this application or known in the art.

In some embodiments, a C11 hydroxylase of the present disclosure is capable of oxidizing mogrol precursors (e.g., cucurbitadienol, 11-hydroxycucurbitadienol, 24,25-dihydroxy-cucurbitadienol, and/or 24,25-epoxy-cucurbitadienol). In some embodiments, a C11 hydroxylase of the present disclosure catalyzes the formation of mogrol.

It should be appreciated that activity, such as specific activity, of a C11 hydroxylase can be determined by any means known to one of ordinary skill in the art. In some embodiments, activity (e.g., specific activity) of a C11 hydroxylase may be measured as the concentration of a mogrol precursor produced or mogrol produced per unit of enzyme per unit time. In some embodiments, a C11 hydroxylase of the present disclosure has an activity (e.g., specific activity) of at least 0.0001-0.001 µmol/min/mg, at least 0.001-0.01 µmol/min/mg, at least 0.01-0.1 µmol/min/mg, or at least 0.1-1 µmol/min/mg, including all values in between.

In some embodiments, the activity, such as specific activity, of a C11 hydroxylase is at least 1.1 fold (e.g., at least 1.3 fold, at least 1.5 fold, at least 1.7 fold, at least 1.9 fold, at least 2 fold, at least 2.5 fold, at least 3 fold, at least 4 fold, at least 5 fold, at least 10 fold, at least 20 fold, at least 30 fold, at least 40 fold, at least 50 fold, at least 100 fold, at least 1000 fold or at least 10000 fold, including all values in between) greater than that of a control C11 hydroxylase.

Cytochrome P450 Reductase Enzymes

Aspects of the present disclosure provide cytochrome P450 reductase enzymes, which may be useful, for example, in the production of mogrol. Cytochrome P450 reductase is also referred to as NADPH:ferrihemoprotein oxidoreductase, NADPH:hemoprotein oxidoreductase, NADPH:P450 oxidoreductase, P450 reductase, POR, CPR, and CYPOR. These reductases can promote C11 hydroxylase activity by catalyzing electron transfer from NADPH to a C11 hydroxylase.

Cytochrome P450 reductases of the present disclosure may comprise a sequence that is at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or at least 100% identical, including all values in between, with a cytochrome P450 reductase sequence (e.g., nucleic acid or amino acid sequence) in Table 8, with a sequence set forth as SEQ ID NOs: 115, 116, 131, or 132, or to any cytochrome p450 reductase disclosed in this application or known in the art.

In some embodiments, a cytochrome P450 reductase of the present disclosure is capable of promoting oxidation of a mogrol precursor (e.g., cucurbitadienol, 11-hydroxy-cucurbitadienol, 24,25-dihydroxy-cucurbitadienol, and/or 24,25-epoxy-cucurbitadienol). In some embodiments, a P450 reductase of the present disclosure catalyzes the formation of a mogrol precursor or mogrol.

It should be appreciated that activity (e.g., specific activity) of a cytochrome P450 reductase can be measured by any means known to one of ordinary skill in the art. In some embodiments, activity (e.g., specific activity) of a recombinant cytochrome P450 reductase may be measured as the concentration of a mogrol precursor produced or mogrol produced per unit enzyme per unit time in the presence of a C11 hydroxylase. In some embodiments, a cytochrome P450 reductase of the present disclosure has a activity (e.g., specific activity) of at least 0.0001-0.001 µmol/min/mg, at least 0.001-0.01 µmol/min/mg, at least 0.01-0.1 µmol/min/mg, or at least 0.1-1 µmol/min/mg, including all values in between.

In some embodiments, the activity (e.g., specific activity) of a cytochrome P450 reductase is at least 1.1 fold (e.g., at least 1.3 fold, at least 1.5 fold, at least 1.7 fold, at least 1.9 fold, at least 2 fold, at least 2.5 fold, at least 3 fold, at least 4 fold, at least 5 fold, at least 10 fold, at least 20 fold, at least 30 fold, at least 40 fold, at least 50 fold, at least 100 fold, at least 1000 fold or at least 10000 fold, including all values in between) greater than that of a control cytochrome P450 reductase.

Epoxide Hydrolase Enzymes (EPHs)

Aspects of the present disclosure provide epoxide hydrolase enzymes (EPHs), which may be useful, for example, in the conversion of 24-25 epoxy-cucurbitadienol to 24-25 dihydroxy-cucurbitadienol or in the conversion of 11-hydroxy-24,25-epoxycucurbitadienol to mogrol. EPHs are capable of converting an epoxide into two hydroxyls.

EPHs of the present disclosure may comprise a sequence that is at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or at least 100% identical, including all values in between, with a EPH sequence (e.g., nucleic acid or amino acid sequence) in Table 8, with a sequence set forth as SEQ ID NOs: 117-125 or 133-141, or to any EPH sequence disclosed in this application or known in the art.

In some embodiments, a recombinant EPH of the present disclosure is capable of promoting hydrolysis of an epoxide in a cucurbitadienol compound (e.g., hydrolysis of the epoxide in 24-25 epoxy-cucurbitadienol). In some embodiments, an EPH of the present disclosure catalyzes the formation of a mogrol precursor (e.g., 24-25 dihydroxy-cucurbitadienol).

It should be appreciated that activity (e.g., specific activity) of an EPH can be measured by any means known to one of ordinary skill in the art. In some embodiments, activity (e.g., specific activity) of an EPH may be measured as the concentration of a mogrol precursor (e.g., 24-25 dihydroxy-cucurbitadienol) or mogrol produced. In some embodiments, a recombinant EPH of the present disclosure will allow production of at least 1-100 μg/L, at least 100-1000 μg/L, at least 1-100 mg/L, at least 100-1000 mg/L, at least 1-10 g/L or at least 10-100 g/L, including all values in between.

In some embodiments, the activity (e.g., specific activity) of an EPH is at least 1.1 fold (e.g., at least 1.3 fold, at least 1.5 fold, at least 1.7 fold, at least 1.9 fold, at least 2 fold, at least 2.5 fold, at least 3 fold, at least 4 fold, at least 5 fold, at least 10 fold, at least 20 fold, at least 30 fold, at least 40 fold, at least 50 fold, or at least 100 fold, including all values in between) greater than that of a control EPH.

Squalene Epoxidases Enzymes (SQEs)

Aspects of the present disclosure provide squalene epoxidases (SQEs), which are capable of oxidizing a squalene (e.g., squalene or 2-3-oxidosqualene) to produce a squalene epoxide (e.g., 2-3-oxidosqualene or 2-3, 22-23-diepoxysqualene). SQEs may also be referred to as squalene monooxygenases.

SQEs of the present disclosure may comprise a sequence that is at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or at least 100% identical, including all values in between, with a SQE sequence (e.g., nucleic acid or amino acid sequence) in Table 8, with a sequence set forth as SEQ ID NOs: 126-128 or 142-144, or to any SQE sequence disclosed in this application or known in the art.

In some embodiments, an SQE of the present disclosure is capable of promoting formation of an epoxide in a squalene compound (e.g., epoxidation of squalene or 2,3-oxidosqualene). In some embodiments, an SQE of the present disclosure catalyzes the formation of a mogrol precursor (e.g., 2-3-oxidosqualene or 2-3, 22-23-diepoxysqualene).

Activity, such as specific activity, of a recombinant SQE may be measured as the concentration of a mogrol precursor (e.g., 2-3-oxidosqualene or 2-3, 22-23-diepoxysqualene) produced per unit of enzyme per unit of time. In some embodiments, an SQE of the present disclosure has an activity, such as specific activity, of at least 0.0000001 μmol/min/mg (e.g., at least 0.000001 μmol/min/mg, at least 0.00001 μmol/min/mg, at least 0.0001 μmol/min/mg, at least 0.001 μmol/min/mg, at least 0.01 μmol/min/mg, at least 0.1 μmol/min/mg, at least 1 μmol/min/mg, at least 10 μmol/min/mg, or at least 100 μmol/min/mg, including all values in between).

In some embodiments, the activity, such as specific activity, of a SQE is at least 1.1 fold (e.g., at least 1.3 fold, at least 1.5 fold, at least 1.7 fold, at least 1.9 fold, at least 2 fold, at least 2.5 fold, at least 3 fold, at least 4 fold, at least 5 fold, at least 10 fold, at least 20 fold, at least 30 fold, at least 40 fold, at least 50 fold, or at least 100 fold, including all values in between) greater than that of a control SQE.

Variants

Aspects of the disclosure relate to polynucleotides encoding any of the recombinant polypeptides described, such as CDS, UGT, C11 hydroxylase, cytochrome P450 reductase, and EPH, and SQE enzymes. Variants of polynucleotide or amino acid sequences described in this application are also encompassed by the present disclosure. A variant may share at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity with a reference sequence, including all values in between.

Unless otherwise noted, the term "sequence identity," as known in the art, refers to a relationship between the sequences of two polypeptides or polynucleotides, as determined by sequence comparison (alignment). In some embodiments, sequence identity is determined across the entire length of a sequence, while in other embodiments, sequence identity is determined over a region of a sequence.

Identity can also refer to the degree of sequence relatedness between two sequences as determined by the number of matches between strings of two or more residues (e.g., nucleic acid or amino acid residues). Identity measures the percent of identical matches between the smaller of two or more sequences with gap alignments (if any) addressed by a particular mathematical model, algorithms, or computer program.

Identity of related polypeptides or nucleic acid sequences can be readily calculated by any of the methods known to one of ordinary skill in the art. The "percent identity" of two sequences (e.g., nucleic acid or amino acid sequences) may, for example, be determined using the algorithm of Karlin and Altschul *Proc. Natl. Acad. Sci. USA* 87:2264-68, 1990, modified as in Karlin and Altschul *Proc. Natl. Acad. Sci. USA* 90:5873-77, 1993. Such an algorithm is incorporated into the NBLAST® and XBLAST® programs (version 2.0) of Altschul et al., *J. Mol. Biol.* 215:403-10, 1990. BLAST® protein searches can be performed, for example, with the XBLAST program, score=50, wordlength=3 to obtain amino acid sequences homologous to the protein molecules of the invention. Where gaps exist between two sequences, Gapped BLAST® can be utilized, for example, as described in Altschul et al., *Nucleic Acids Res.* 25(17):3389-3402, 1997. When utilizing BLAST® and Gapped BLAST® programs, the default parameters of the respective programs (e.g., XBLAST® and NBLAST®) can be used, or the parameters can be adjusted appropriately as would be understood by one of ordinary skill in the art.

Another local alignment technique which may be used, for example, is based on the Smith-Waterman algorithm (Smith, T. F. & Waterman, M. S. (1981) "Identification of common molecular subsequences." *J. Mol. Biol.* 147:195-197). A general global alignment technique which may be used, for example, is the Needleman-Wunsch algorithm (Needleman, S. B. & Wunsch, C. D. (1970) "A general method applicable to the search for similarities in the amino acid sequences of two proteins." *J. Mol. Biol.* 48:443-453), which is based on dynamic programming.

More recently, a Fast Optimal Global Sequence Alignment Algorithm (FOGSAA) was developed that purportedly produces global alignment of nucleic acid and amino acid sequences faster than other optimal global alignment methods, including the Needleman-Wunsch algorithm. In some embodiments, the identity of two polypeptides is determined by aligning the two amino acid sequences, calculating the number of identical amino acids, and dividing by the length of one of the amino acid sequences. In some embodiments, the identity of two nucleic acids is determined by aligning the two nucleotide sequences and calculating the number of identical nucleotide and dividing by the length of one of the nucleic acids.

For multiple sequence alignments, computer programs including Clustal Omega (Sievers et al., Mol Syst Biol. 2011 Oct. 11; 7:539) may be used.

It should be appreciated that a sequence, including a nucleic acid or amino acid sequence, may be found to have a specified percent identity to a reference sequence, such as a sequence disclosed in this application and/or recited in the claims, using any method known to one of ordinary skill in the art. Different algorithms may yield different percent identity values for a given set of sequences. The claims of this application should be understood to encompass sequences for which percent identity to a reference sequence is calculated using default parameters and/or parameters typically used by the skilled artisan for a given algorithm.

As used in this application, a residue (such as a nucleic acid residue or an amino acid residue) in sequence "X" is referred to as corresponding to a position or residue (such as a nucleic acid residue or an amino acid residue) "z" in a different sequence "Y" when the residue in sequence "X" is at the counterpart position of "z" in sequence "Y" when sequences X and Y are aligned using amino acid sequence alignment tools known in the art.

Variant sequences may be homologous sequences. As used in this application, homologous sequences are sequences (e.g., nucleic acid or amino acid sequences) that share a certain percent identity (e.g., at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% percent identity, including all values in between).

Homologous sequences include but are not limited to paralogous sequences, orthologous sequences, or sequences arising from convergent evolution. Paralogous sequences arise from duplication of a gene within a genome of a species, while orthologous sequences diverge after a speciation event. Two different species may have evolved independently but may each comprise a sequence that shares a certain percent identity with a sequence from the other species as a result of convergent evolution.

In some embodiments, a polypeptide variant (e.g., CDS, UGT, C11 hydroxylase, cytochrome P450 reductase, EPH, or SQE variant) comprises a domain that shares a secondary structure (e.g., alpha helix, beta sheet) with a reference polypeptide (e.g., a reference CDS, UGT, C11 hydroxylase, cytochrome P450 reductase, EPH, or SQE). In some embodiments, a polypeptide variant (e.g., CDS, UGT, C11 hydroxylase, cytochrome P450 reductase, EPH, or SQE variant) shares a tertiary structure with a reference polypeptide (e.g., a reference CDS, UGT, C11 hydroxylase, cytochrome P450 reductase, EPH, or SQE). As a non-limiting example, a variant polypeptide may have low primary sequence identity (e.g., less than 80%, less than 75%, less than 70%, less than 65%, less than 60%, less than 55%, less than 50%, less than 45%, less than 40%, less than 35%, less than 30%, less than 25%, less than 20%, less than 15%, less than 10%, or less than 5% sequence identity) compared to a reference polypeptide, but share one or more secondary structures (e.g., including but not limited to loops, alpha helices, or beta sheets, or have the same tertiary structure as a reference polypeptide. For example, a loop may be located between a beta sheet and an alpha helix, between two alpha helices, or between two beta sheets. Homology modeling may be used to compare two or more tertiary structures.

Mutations can be made in a nucleotide sequence by a variety of methods known to one of ordinary skill in the art. For example, mutations can be made by PCR-directed mutation, site-directed mutagenesis according to the method of Kunkel (Kunkel, *Proc. Nat. Acad. Sci. U.S.A.* 82: 488-492, 1985), by chemical synthesis of a gene encoding a polypeptide, by gene editing tools, or by insertions, such as insertion of a tag (e.g., a HIS tag or a GFP tag). Mutations can include, for example, substitutions, deletions, and translocations, generated by any method known in the art. Methods for producing mutations may be found in in references such as Molecular Cloning: A Laboratory Manual, J. Sambrook, et al., eds., Fourth Edition, Cold Spring Harbor Laboratory Press, Cold Spring Harbor, New York, 2012, or Current Protocols in Molecular Biology, F. M. Ausubel, et al., eds., John Wiley & Sons, Inc., New York, 2010.

In some embodiments, methods for producing variants include circular permutation (Yu and Lutz, *Trends Biotechnol.* 2011 January; 29(1):18-25). A non-limiting example of circular permutation is provided in Example 5 and FIG. 7. In circular permutation, the linear primary sequence of a polypeptide can be circularized (e.g., by joining the N-terminal and C-terminal ends of the sequence) and the polypeptide can be severed ("broken") at a different location. Thus, the linear primary sequence of the new polypeptide may have low sequence identity (e.g., less than 80%, less than 75%, less than 70%, less than 65%, less than 60%, less than 55%, less than 50%, less than 45%, less than 40%, less than 35%, less than 30%, less than 25%, less than 20%, less than 15%, less than 10%, less or less than 5%, including all values in between) as determined by linear sequence alignment methods (e.g., Clustal Omega or BLAST). Topological analysis of the two proteins, however, may reveal that the tertiary structure of the two polypeptides is similar or dissimilar. Without being bound by a particular theory, a variant polypeptide created through circular permutation of a reference polypeptide and with a similar tertiary structure as the reference polypeptide can share similar functional characteristics (e.g., enzymatic activity, enzyme kinetics, substrate specificity or product specificity). In some instances, circular permutation may alter the secondary structure, tertiary structure or quaternary structure and produce an enzyme with different functional characteristics (e.g., increased or decreased enzymatic activity, different substrate specificity, or different product specificity). See, e.g., Yu and Lutz, *Trends Biotechnol.* 2011 January; 29(1):18-25.

It should be appreciated that in a protein that has undergone circular permutation, the linear amino acid sequence of the protein would differ from a reference protein that has not undergone circular permutation. However, one of ordinary skill in the art would be able to determine which residues in the protein that has undergone circular permutation correspond to residues in the reference protein that has not undergone circular permutation by, for example, aligning the sequences and detecting conserved motifs, and/or by comparing the structures or predicted structures of the proteins, e.g., by homology modeling.

In some embodiments, an algorithm that determines the percent identity between a sequence of interest and a reference sequence described in this application accounts for the presence of circular permutation between the sequences. The presence of circular permutation may be detected using any method known in the art, including, for example, RASPODOM (Weiner et al., Bioinformatics. 2005 Apr. 1; 21(7):932-7). In some embodiments, the presence of circulation permutation is corrected for (e.g., the domains in at least one sequence are rearranged) prior to calculation of the percent identity between a sequence of interest and a sequence described in this application. The claims of this application should be understood to encompass sequences for which percent identity to a reference sequence is calculated after taking into account potential circular permutation of the sequence.

Functional variants of the recombinant CDSs, UGTs, C11 hydroxylases, cytochrome P450 reductases, EPHs, and squalene epoxidases disclosed in this application are also encompassed by the present disclosure. For example, functional variants may bind one or more of the same substrates (e.g., mogrol, mogroside, or precursors thereof) or produce one or more of the same products (e.g., mogrol, mogroside, or precursors thereof). Functional variants may be identified using any method known in the art. For example, the algorithm of Karlin and Altschul *Proc. Natl. Acad. Sci. USA* 87:2264-68, 1990 described above may be used to identify homologous proteins with known functions.

Putative functional variants may also be identified by searching for polypeptides with functionally annotated domains. Databases including Pfam (Sonnhammer et al., Proteins. 1997 July; 28(3):405-20) may be used to identify polypeptides with a particular domain. For example, among oxidosqualene cyclases, additional CDS enzymes may be identified in some instances by searching for polypeptides with a leucine residue corresponding to position 123 of SEQ ID NO: 74. This leucine residue has been implicated in determining the product specificity of the CDS enzyme; mutation of this residue can, for instance, result in cycloartenol or parkeol as a product (Takase et al., *Org Biomol Chem.* 2015 Jul. 13(26):7331-6).

Additional UGT enzymes may be identified, for example, by searching for polypeptides with a UDPGT domain (PROSITE accession number PS00375).

Homology modeling may also be used to identify amino acid residues that are amenable to mutation without affecting function. A non-limiting example of such a method may include use of position-specific scoring matrix (PSSM) and an energy minimization protocol (see, e.g., Example 5 below). See, e.g., Stormo et al., *Nucleic Acids Res.* 1982 May 11; 10(9):2997-3011.

PSSM may be paired with calculation of a Rosetta energy function, which determines the difference between the wild-type and the single-point mutant. Without being bound by a particular theory, potentially stabilizing mutations are desirable for protein engineering (e.g., production of functional homologs). In some embodiments, a potentially stabilizing mutation has a $\Delta\Delta G_{calc}$ value of less than −0.1 (e.g., less than −0.2, less than −0.3, less than −0.35, less than −0.4, less than −0.45, less than −0.5, less than −0.55, less than −0.6, less than −0.65, less than −0.7, less than −0.75, less than −0.8, less than −0.85, less than −0.9, less than −0.95, or less than −1.0) Rosetta energy units (R.e.u.). See, e.g., Goldenzweig et al., *Mol Cell.* 2016 Jul. 21; 63(2):337-346. doi: 10.1016/j.molcel.2016.06.012.

In some embodiments, a CDS, UGT, C11 hydroxylase, cytochrome P450 reductase, EPH, or SQE coding sequence comprises a mutation at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more than 100 positions corresponding to a reference coding sequence. In some embodiments, the CDS, UGT, C11 hydroxylase, cytochrome P450 reductase, EPH, or SQE coding sequence comprises a mutation in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more codons of the coding sequence relative to a reference coding sequence. As will be understood by one of ordinary skill in the art, a mutation within a codon may or may not change the amino acid that is encoded by the codon due to degeneracy of the genetic code. In some embodiments, the one or more mutations in the coding sequence do not alter the amino acid sequence of the coding sequence relative to the amino acid sequence of a reference polypeptide.

In some embodiments, the one or more mutations in a recombinant CDS, UGT, C11 hydroxylase, cytochrome P450 reductase, EPH, or SQE sequence alter the amino acid sequence of the polypeptide relative to the amino acid sequence of a reference polypeptide. In some embodiments, the one or more mutations alter the amino acid sequence of the recombinant polypeptide relative to the amino acid sequence of a reference polypeptide and alter (enhance or reduce) an activity of the polypeptide relative to the reference polypeptide.

The activity, including specific activity, of any of the recombinant polypeptides described in this application may be measured using routine methods. As a non-limiting example, a recombinant polypeptide's activity may be determined by measuring its substrate specificity, product(s) produced, the concentration of product(s) produced, or any combination thereof. As used in this application, "specific activity" of a recombinant polypeptide refers to the amount (e.g., concentration) of a particular product produced for a given amount (e.g., concentration) of the recombinant polypeptide per unit time.

The skilled artisan will also realize that mutations in a recombinant polypeptide coding sequence may result in conservative amino acid substitutions to provide functionally equivalent variants of the foregoing polypeptides, e.g., variants that retain the activities of the polypeptides. As used in this application, a "conservative amino acid substitution" refers to an amino acid substitution that does not alter the relative charge or size characteristics or functional activity of the protein in which the amino acid substitution is made.

In some instances, an amino acid is characterized by its R group (see, e.g., Table 1). For example, an amino acid may comprise a nonpolar aliphatic R group, a positively charged R group, a negatively charged R group, a nonpolar aromatic R group, or a polar uncharged R group. Non-limiting examples of an amino acid comprising a nonpolar aliphatic R group include alanine, glycine, valine, leucine, methionine, and isoleucine. Non-limiting examples of an amino acid comprising a positively charged R group includes lysine, arginine, and histidine. Non-limiting examples of an amino acid comprising a negatively charged R group include aspartate and glutamate. Non-limiting examples of an amino acid comprising a nonpolar, aromatic R group include phenylalanine, tyrosine, and tryptophan. Non-limiting examples of an amino acid comprising a polar uncharged R group include serine, threonine, cysteine, proline, asparagine, and glutamine.

Non-limiting examples of functionally equivalent variants of polypeptides may include conservative amino acid substitutions in the amino acid sequences of proteins disclosed in this application. Conservative substitutions of amino acids include substitutions made amongst amino acids within the following groups: (a) M, I, L, V; (b) F, Y, W; (c) K, R, H; (d) A, G; (e) S, T; (f) Q, N; and (g) E, D. Additional non-limiting examples of conservative amino acid substitutions are provided in Table 1.

In some embodiments, 1, 2, 3, 4, 5, 6, 7, 8, 9, 10, 11, 12, 13, 14, 15, 16, 17, 18, 19, 20 or more than 20 residues can be changed when preparing variant polypeptides. In some embodiments, amino acids are replaced by conservative amino acid substitutions.

TABLE 1

Non-limiting Examples of conservative amino acid substitutions

| Original Residue | R Group Type | Conservative Amino Acid Substitutions |
|---|---|---|
| Ala | nonpolar aliphatic R group | Cys, Gly, Ser |
| Arg | positively charged R group | His, Lys |
| Asn | polar uncharged R group | Asp, Gln, Glu |
| Asp | negatively charged R group | Asn, Gln, Glu |
| Cys | polar uncharged R group | Ala, Ser |
| Gln | polar uncharged R group | Asn, Asp, Glu |
| Glu | negatively charged R group | Asn, Asp, Gln |
| Gly | nonpolar aliphatic R group | Ala, Ser |
| His | positively charged R group | Arg, Tyr, Trp |
| Ile | nonpolar aliphatic R group | Leu, Met, Val |
| Leu | nonpolar aliphatic R group | Ile, Met, Val |
| Lys | positively charged R group | Arg, His |
| Met | nonpolar aliphatic R group | Ile, Leu, Phe, Val |
| Pro | polar uncharged R group | |
| Phe | nonpolar aromatic R group | Met, Trp, Tyr |
| Ser | polar uncharged R group | Ala, Gly, Thr |
| Thr | polar uncharged R group | Ala, Asn, Ser |

TABLE 1-continued

Non-limiting Examples of conservative amino acid substitutions

| Original Residue | R Group Type | Conservative Amino Acid Substitutions |
|---|---|---|
| Trp | nonpolar aromatic R group | His, Phe, Tyr, Met |
| Tyr | nonpolar aromatic R group | His, Phe, Trp |
| Val | nonpolar aliphatic R group | Ile, Leu, Met, Thr |

Amino acid substitutions in the amino acid sequence of a polypeptide to produce a recombinant polypeptide variant having a desired property and/or activity can be made by alteration of the coding sequence of the polypeptide. Similarly, conservative amino acid substitutions in the amino acid sequence of a polypeptide to produce functionally equivalent variants of the polypeptide typically are made by alteration of the coding sequence of the recombinant polypeptide (e.g., UGT, CDS, P450, cytochrome P450 reductase, EPH, or squalene epoxidase).

Expression of Nucleic Acids in Host Cells

Aspects of the present disclosure relate to the recombinant expression of genes encoding enzymes, functional modifications and variants thereof, as well as uses relating thereto. For example, the methods described in this application may be used to produce mogrol precursors, mogrol and/or mogrosides.

The term "heterologous" with respect to a polynucleotide, such as a polynucleotide comprising a gene, is used interchangeably with the term "exogenous" and the term "recombinant" and refers to: a polynucleotide that has been artificially supplied to a biological system; a polynucleotide that has been modified within a biological system; or a polynucleotide whose expression or regulation has been manipulated within a biological system. A heterologous polynucleotide that is introduced into or expressed in a host cell may be a polynucleotide that comes from a different organism or species than the host cell, or may be a synthetic polynucleotide, or may be a polynucleotide that is also endogenously expressed in the same organism or species as the host cell. For example, a polynucleotide that is endogenously expressed in a host cell may be considered heterologous when it is: situated non-naturally in the host cell; expressed recombinantly in the host cell, either stably or transiently; modified within the host cell; selectively edited within the host cell; expressed in a copy number that differs from the naturally occurring copy number within the host cell; or expressed in a non-natural way within the host cell, such as by manipulating regulatory regions that control expression of the polynucleotide. In some embodiments, a heterologous polynucleotide is a polynucleotide that is endogenously expressed in a host cell but whose expression is driven by a promoter that does not naturally regulate expression of the polynucleotide. In other embodiments, a heterologous polynucleotide is a polynucleotide that is endogenously expressed in a host cell and whose expression is driven by a promoter that does naturally regulate expression of the polynucleotide, but the promoter or another regulatory region is modified. In some embodiments, the promoter is recombinantly activated or repressed. For example, gene-editing based techniques may be used to regulate expression of a polynucleotide, including an endogenous polynucleotide, from a promoter, including an endogenous promoter. See, e.g., Chavez et al., Nat Methods. 2016 July; 13(7): 563-567. A heterologous polynucleotide may comprise a wild-type sequence or a mutant sequence as compared with a reference polynucleotide sequence.

A nucleic acid encoding any of the recombinant polypeptides, such as CDSs, UGTs, C11 hydroxylases, cytochrome P450 reductases, EPHs, or SQEs) described in this application may be incorporated into any appropriate vector through any method known in the art. For example, the vector may be an expression vector, including but not limited to a viral vector (e.g., a lentiviral, retroviral, adenoviral, or adeno-associated viral vector), any vector suitable for transient expression, any vector suitable for constitutive expression, or any vector suitable for inducible expression (e.g., a galactose-inducible or doxycycline-inducible vector). A non-limiting example of a vector for expression of a recombinant polypeptide (e.g., CDS, UGT, C11 hydroxylase, cytochrome P450 reductase, EPH, or squalene epoxidase) is described in Example 1 below.

In some embodiments, a vector replicates autonomously in the cell. A vector can contain one or more endonuclease restriction sites that are cut by a restriction endonuclease to insert and ligate a nucleic acid containing a gene described in this application to produce a recombinant vector that is able to replicate in a cell. Vectors are typically composed of DNA, although RNA vectors are also available. Cloning vectors include, but are not limited to: plasmids, fosmids, phagemids, virus genomes and artificial chromosomes. As used in this application, the terms "expression vector" or "expression construct" refer to a nucleic acid construct, generated recombinantly or synthetically, with a series of specified nucleic acid elements that permit transcription of a particular nucleic acid in a host cell, such as a yeast cell. In some embodiments, the nucleic acid sequence of a gene described in this application is inserted into a cloning vector such that it is operably joined to regulatory sequences and, in some embodiments, expressed as an RNA transcript. In some embodiments, the vector contains one or more markers, such as a selectable marker as described in this application, to identify cells transformed or transfected with the recombinant vector. In some embodiments, the nucleic acid sequence of a gene described in this application is re-coded. Re-coding may increase production of the gene product by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or 100%, including all values in between) relative to a reference sequence that is not re-coded.

A coding sequence and a regulatory sequence are said to be "operably joined" or "operably linked" when the coding sequence and the regulatory sequence are covalently linked and the expression or transcription of the coding sequence is under the influence or control of the regulatory sequence. If the coding sequence is to be translated into a functional protein, the coding sequence and the regulatory sequence are said to be operably joined or linked if induction of a promoter in the 5' regulatory sequence permits the coding sequence to be transcribed and if the nature of the linkage between the coding sequence and the regulatory sequence does not (1) result in the introduction of a frame-shift mutation, (2) interfere with the ability of the promoter region to direct the transcription of the coding sequence, or (3) interfere with the ability of the corresponding RNA transcript to be translated into a protein.

In some embodiments, the nucleic acid encoding any of the proteins described in this application is under the control of regulatory sequences (e.g., enhancer sequences). In some embodiments, a nucleic acid is expressed under the control of a promoter. The promoter can be a native promoter, e.g., the promoter of the gene in its endogenous context, which provides normal regulation of expression of the gene. Alternatively, a promoter can be a promoter that is different from the native promoter of the gene, e.g., the promoter is different from the promoter of the gene in its endogenous context. As used in this application, a "heterologous promoter" or "recombinant promoter" is a promoter that is not naturally or normally associated with or that does not naturally or normally control transcription of a DNA sequence to which it is operably joined. In some embodiments, a nucleotide sequence is under the control of a heterologous promoter.

In some embodiments, the promoter is a eukaryotic promoter. Non-limiting examples of eukaryotic promoters include TDH3, PGK1, PKC1, PDC1, TEF1, TEF2, RPL18B, SSA1, TDH2, PYK1, TPI1 GAL1, GAL10, GAL7, GAL3, GAL2, MET3, MET25, HXT3, HXT7, ACT1, ADH1, ADH2, CUP1-1, ENO2, and SOD1, as would be known to one of ordinary skill in the art (see, e.g., Addgene website: blog.addgene.org/plasmids-101-the-promoter-region). In some embodiments, the promoter is a prokaryotic promoter (e.g., bacteriophage or bacterial promoter). Non-limiting examples of bacteriophage promoters include Pls1con, T3, T7, SP6, and PL. Non-limiting examples of bacterial promoters include Pbad, PmgrB, Ptrc2, Plac/ara, Ptac, and Pm.

In some embodiments, the promoter is an inducible promoter. As used in this application, an "inducible promoter" is a promoter controlled by the presence or absence of a molecule. Non-limiting examples of inducible promoters include chemically-regulated promoters and physically-regulated promoters. For chemically-regulated promoters, the transcriptional activity can be regulated by one or more compounds, such as alcohol, tetracycline, galactose, a steroid, a metal, or other compounds. For physically-regulated promoters, transcriptional activity can be regulated by a phenomenon such as light or temperature. Non-limiting examples of tetracycline-regulated promoters include anhydrotetracycline (aTc)-responsive promoters and other tetracycline-responsive promoter systems (e.g., a tetracycline repressor protein (tetR), a tetracycline operator sequence (tetO) and a tetracycline transactivator fusion protein (tTA)). Non-limiting examples of steroid-regulated promoters include promoters based on the rat glucocorticoid receptor, human estrogen receptor, moth ecdysone receptors, and promoters from the steroid/retinoid/thyroid receptor superfamily. Non-limiting examples of metal-regulated promoters include promoters derived from metallothionein (proteins that bind and sequester metal ions) genes. Non-limiting examples of pathogenesis-regulated promoters include promoters induced by salicylic acid, ethylene or benzothiadiazole (BTH). Non-limiting examples of temperature/heat-inducible promoters include heat shock promoters. Non-limiting examples of light-regulated promoters include light responsive promoters from plant cells. In certain embodiments, the inducible promoter is a galactose-inducible promoter. In some embodiments, the inducible promoter is induced by one or more physiological conditions (e.g., pH, temperature, radiation, osmotic pressure, saline gradients, cell surface binding, or concentration of one or more extrinsic or intrinsic inducing agents). Non-limiting examples of an extrinsic inducer or inducing agent include amino acids and amino acid analogs, saccharides and polysaccharides, nucleic acids, protein transcriptional activators and repressors, cytokines, toxins, petroleum-based compounds, metal containing compounds, salts, ions, enzyme substrate analogs, hormones or any combination thereof.

In some embodiments, the promoter is a constitutive promoter. As used in this application, a "constitutive promoter" refers to an unregulated promoter that allows continuous transcription of a gene. Non-limiting examples of a constitutive promoter include TDH3, PGK1, PKC1, PDC1, TEF1, TEF2, RPL18B, SSA1, TDH2, PYK1, TPI1, HXT3, HXT7, ACT1, ADH1, ADH2, ENO2, and SOD1.

Other inducible promoters or constitutive promoters known to one of ordinary skill in the art are also contemplated.

The precise nature of the regulatory sequences needed for gene expression may vary between species or cell types, but generally include, as necessary, 5' non-transcribed and 5' non-translated sequences involved with the initiation of transcription and translation respectively, such as a TATA box, capping sequence, CAAT sequence, and the like. In particular, such 5' non-transcribed regulatory sequences will include a promoter region which includes a promoter sequence for transcriptional control of the operably joined gene. Regulatory sequences may also include enhancer sequences or upstream activator sequences. The vectors disclosed in this application may include 5' leader or signal sequences. The regulatory sequence may also include a terminator sequence. In some embodiments, a terminator sequence marks the end of a gene in DNA during transcription. The choice and design of one or more appropriate vectors suitable for inducing expression of one or more genes described in this application in a host cell is within the ability and discretion of one of ordinary skill in the art.

Expression vectors containing the necessary elements for expression are commercially available and known to one of ordinary skill in the art (see, e.g., Sambrook et al., Molecular Cloning: A Laboratory Manual, Fourth Edition, Cold Spring Harbor Laboratory Press, 2012).

In some embodiments, introduction of a polynucleotide, such as a polynucleotide encoding a recombinant polypeptide, into a host cell results in genomic integration of the polynucleotide. In some embodiments, a host cell comprises at least 1 copy, at least 2 copies, at least 3 copies, at least 4 copies, at least 5 copies, at least 6 copies, at least 7 copies, at least 8 copies, at least 9 copies, at least 10 copies, at least 11 copies, at least 12 copies, at least 13 copies, at least 14 copies, at least 15 copies, at least 16 copies, at least 17 copies, at least 18 copies, at least 19 copies, at least 20 copies, at least 21 copies, at least 22 copies, at least 23 copies, at least 24 copies, at least 25 copies, at least 26 copies, at least 27 copies, at least 28 copies, at least 29 copies, at least 30 copies, at least 31 copies, at least 32 copies, at least 33 copies, at least 34 copies, at least 35 copies, at least 36 copies, at least 37 copies, at least 38 copies, at least 39 copies, at least 40 copies, at least 41 copies, at least 42 copies, at least 43 copies, at least 44 copies, at least 45 copies, at least 46 copies, at least 47 copies, at least 48 copies, at least 49 copies, at least 50 copies, at least 60 copies, at least 70 copies, at least 80 copies, at least 90 copies, at least 100 copies, or more, including any values in between, of a polynucleotide sequence, such as a polynucleotide sequence encoding any of the recombinant polypeptides described in this application, in its genome.

Host Cells

Any of the proteins or enzymes of the disclosure may be expressed in a host cell. As used in this application, the term "host cell" refers to a cell that can be used to express a polynucleotide, such as a polynucleotide that encodes an enzyme used in production of mogrol, mogrosides, and precursors thereof.

Any suitable host cell may be used to produce any of the recombinant polypeptides, including CDSs, UGTs, C11 hydroxylases, cytochrome P450 reductases, EPHs, and SQEs disclosed in this application, including eukaryotic cells or prokaryotic cells. Suitable host cells include, but are not limited to, fungal cells (e.g., yeast cells), bacterial cells (e.g., *E. coli* cells), algal cells, plant cells, insect cells, and animal cells, including mammalian cells.

Suitable yeast host cells include, but are not limited to, *Candida, Escherichia, Hansenula, Saccharomyces* (e.g., *S. cerevisiae*), *Schizosaccharomyces, Pichia, Kluyveromyces* (e.g., *K. lactis*), and *Yarrowia*. In some embodiments, the yeast cell is *Hansenula polymorpha, Saccharomyces cerevisiae, Saccharomyces carlsbergensis, Saccharomyces diastaticus, Saccharomyces norbensis, Saccharomyces kluyveri, Schizosaccharomyces pombe, Pichia finlandica, Pichia trehalophila, Pichia kodamae, Pichia membranaefaciens, Pichia opuntiae, Pichia thermotolerans, Pichia salictaria, Pichia quercuum, Pichia pijperi, Pichia stipitis, Pichia methanolica, Pichia angusta, Kluyveromyces lactis, Candida albicans,* or *Yarrowia lipolytica*.

In some embodiments, the yeast strain is an industrial polyploid yeast strain. Other non-limiting examples of fungal cells include cells obtained from *Aspergillus* spp., *Penicillium* spp., *Fusarium* spp., *Rhizopus* spp., *Acremonium* spp., *Neurospora* spp., *Sordaria* spp., *Magnaporthe* spp., *Allomyces* spp., *Ustilago* spp., *Botrytis* spp., and *Trichoderma* spp.

In certain embodiments, the host cell is an algal cell such as, *Chlamydomonas* (e.g., *C. Reinhardtii*) and *Phormidium* (P. sp. ATCC29409).

In other embodiments, the host cell is a prokaryotic cell. Suitable prokaryotic cells include gram positive, gram negative, and gram-variable bacterial cells. The host cell may be a species of, but not limited to: *Agrobacterium, Alicyclobacillus, Anabaena, Anacystis, Acinetobacter, Acidothermus, Arthrobacter, Azobacter, Bacillus, Bifidobacterium, Brevibacterium, Butyrivibrio, Buchnera, Campestris, Camplyobacter, Clostridium, Corynebacterium, Chromatium, Coprococcus, Escherichia, Enterococcus, Enterobacter, Erwinia, Fusobacterium, Faecalibacterium, Francisella, Flavobacterium, Geobacillus, Haemophilus, Helicobacter, Klebsiella, Lactobacillus, Lactococcus, Ilyobacter, Micrococcus, Microbacterium, Mesorhizobium, Methylobacterium, Methylobacterium, Mycobacterium, Neisseria, Pantoea, Pseudomonas, Prochlorococcus, Rhodobacter, Rhodopseudomonas, Rhodopseudomonas, Roseburia, Rhodospirillum, Rhodococcus, Scenedesmus, Streptomyces, Streptococcus, Synecoccus, Saccharomonospora, Saccharopolyspora, Staphylococcus, Serratia, Salmonella, Shigella, Thermoanaerobacterium, Tropheryma, Tularensis, Temecula, Thermosynechococcus, Thermococcus, Ureaplasma, Xanthomonas, Xylella, Yersinia,* and *Zymomonas*.

In some embodiments, the bacterial host cell is of the *Agrobacterium* species (e.g., *A. radiobacter, A. rhizogenes, A. rubi*), the *Arthrobacter* species (e.g., *A. aurescens, A. citreus, A. globformis, A. hydrocarboglutamicus, A. mysorens, A. nicotianae, A. paraffineus, A. protophonniae, A. roseoparaffinus, A. sulfureus, A. ureafaciens*), or the *Bacillus* species (e.g., *B. thuringiensis, B. anthracis, B. megaterium, B. subtilis, B. lentus, B. circulans, B. pumilus, B. lautus, B. coagulans, B. brevis, B. firmus, B. alkaophius, B. licheniformis, B. clausii, B. stearothermophilus, B. halodurans* and *B. amyloliquefaciens*. In particular embodiments, the host cell is an industrial *Bacillus* strain including but not limited to *B. subtilis, B. pumilus, B. licheniformis, B. megaterium, B. clausii, B. stearothermophilus* and *B. amyloliquefaciens*. In some embodiments, the host cell is an industrial *Clostridium* species (e.g., *C. acetobutylicum, C. tetani* E88, *C. litusebu-rense, C. saccharobutylicum, C. perfringens, C. beijer-inckii*). In some embodiments, the host cell is an industrial *Corynebacterium* species (e.g., *C. glutamicum, C. acetoaci-dophilum*). In some embodiments, the host cell is an industrial *Escherichia* species (e.g., *E. coli*). In some embodiments, the host cell is an industrial *Erwinia* species (e.g., *E. uredovora, E. carotovora, E. ananas, E. herbicola, E. punctata, E. terreus*). In some embodiments, the host cell is an industrial *Pantoea* species (e.g., *P. citrea, P. agglomerans*). In some embodiments, the host cell is an industrial *Pseudomonas* species, (e.g., *P. putida, P. aeruginosa, P. mevalonii*). In some embodiments, the host cell is an industrial *Streptococcus* species (e.g., *S. equisimiles, S. pyogenes, S. uberis*). In some embodiments, the host cell is an industrial *Streptomyces* species (e.g., *S. ambofaciens, S. achromogenes, S. avermitilis, S. coelicolor, S. aureofaciens, S. aureus, S. fungicidicus, S. griseus, S. lividans*). In some embodiments, the host cell is an industrial *Zymomonas* species (e.g., *Z. mobilis, Z. lipolytica*).

The present disclosure is also suitable for use with a variety of animal cell types, including mammalian cells, for example, human (including 293, HeLa, WI38, PER.C6 and Bowes melanoma cells), mouse (including 3T3, NS0, NS1, Sp2/0), hamster (CHO, BHK), monkey (COS, FRhL, Vero), and hybridoma cell lines.

The present disclosure is also suitable for use with a variety of plant cell types.

The term "cell," as used in this application, may refer to a single cell or a population of cells, such as a population of cells belonging to the same cell line or strain. Use of the singular term "cell" should not be construed to refer explicitly to a single cell rather than a population of cells.

The host cell may comprise genetic modifications relative to a wild-type counterpart. As a non-limiting example, a host cell (e.g., *S. cerevisiae*) may be modified to reduce or inactivate one or more of the following genes: hydroxymethylglutaryl-CoA (HMG-CoA) reductase (HMG1), acetyl-CoA C-acetyltransferase (acetoacetyl-CoA thiolase) (ERG10), 3-hydroxy-3-methylglutaryl-CoA (HMG-CoA) synthase (ERG13), farnesyl-diphosphate farnesyl transferase (squalene synthase) (ERG9), may be modified to overexpress squalene epoxidase (ERG1), or may be modified to downregulate lanosterol synthase (ERG7). See, e.g., Examples 1 and 2 below.

Reduction of gene expression and/or gene inactivation may be achieved through any suitable method, including but not limited to deletion of the gene, introduction of a point mutation into the gene, truncation of the gene, introduction of an insertion into the gene, introduction of a tag or fusion into the gene, or selective editing of the gene. For example, polymerase chain reaction (PCR)-based methods may be used (see, e.g., Gardner et al., *Methods Mol Biol.* 2014; 1205:45-78) or well-known gene-editing techniques may be used. As a non-limiting example, genes may be deleted through gene replacement (e.g., with a marker, including a selection marker). A gene may also be truncated through the use of a transposon system (see, e.g., Poussu et al., *Nucleic Acids Res.* 2005; 33(12): e104).

A vector encoding any of the recombinant polypeptides described in this application may be introduced into a suitable host cell using any method known in the art. Non-limiting examples of yeast transformation protocols are described in Gietz et al., Yeast transformation can be conducted by the LiAc/SS Carrier DNA/PEG method. *Methods Mol Biol.* 2006; 313:107-20, which is incorporated by reference in its entirety. Host cells may be cultured under any suitable conditions as would be understood by one of ordinary skill in the art. For example, any media, temperature, and incubation conditions known in the art may be used. For host cells carrying an inducible vector, cells may be cultured with an appropriate inducible agent to promote expression.

Any of the cells disclosed in this application can be cultured in media of any type (rich or minimal) and any composition prior to, during, and/or after contact and/or integration of a nucleic acid. The conditions of the culture or culturing process can be optimized through routine experimentation as would be understood by one of ordinary skill in the art. In some embodiments, the selected media is supplemented with various components. In some embodiments, the concentration and amount of a supplemental component is optimized. In some embodiments, other aspects of the media and growth conditions (e.g., pH, temperature, etc.) are optimized through routine experimentation. In some embodiments, the frequency that the media is supplemented with one or more supplemental components, and the amount of time that the cell is cultured, is optimized.

Culturing of the cells described in this application can be performed in culture vessels known and used in the art. In some embodiments, an aerated reaction vessel (e.g., a stirred tank reactor) is used to culture the cells. In some embodiments, a bioreactor or fermentor is used to culture the cell. Thus, in some embodiments, the cells are used in fermentation. As used in this application, the terms "bioreactor" and "fermentor" are interchangeably used and refer to an enclosure, or partial enclosure, in which a biological, biochemical and/or chemical reaction takes place, involving a living organism, part of a living organism, or purified enzymes. A "large-scale bioreactor" or "industrial-scale bioreactor" is a bioreactor that is used to generate a product on a commercial or quasi-commercial scale. Large scale bioreactors typically have volumes in the range of liters, hundreds of liters, thousands of liters, or more.

Non-limiting examples of bioreactors include: stirred tank fermentors, bioreactors agitated by rotating mixing devices, chemostats, bioreactors agitated by shaking devices, airlift fermentors, packed-bed reactors, fixed-bed reactors, fluidized bed bioreactors, bioreactors employing wave induced agitation, centrifugal bioreactors, roller bottles, and hollow fiber bioreactors, roller apparatuses (for example benchtop, cart-mounted, and/or automated varieties), vertically-stacked plates, spinner flasks, stirring or rocking flasks, shaken multi-well plates, MD bottles, T-flasks, Roux bottles, multiple-surface tissue culture propagators, modified fermentors, and coated beads (e.g., beads coated with serum proteins, nitrocellulose, or carboxymethyl cellulose to prevent cell attachment).

In some embodiments, the bioreactor includes a cell culture system where the cell (e.g., yeast cell) is in contact with moving liquids and/or gas bubbles. In some embodiments, the cell or cell culture is grown in suspension. In other embodiments, the cell or cell culture is attached to a solid phase carrier. Non-limiting examples of a carrier system includes microcarriers (e.g., polymer spheres, microbeads, and microdisks that can be porous or non-porous), cross-linked beads (e.g., dextran) charged with specific chemical groups (e.g., tertiary amine groups), 2D microcarriers including cells trapped in nonporous polymer fibers, 3D carriers (e.g., carrier fibers, hollow fibers, multicartridge reactors, and semi-permeable membranes that can comprising porous fibers), microcarriers having reduced ion exchange capacity, encapsulation cells, capillaries, and aggregates. In some embodiments, carriers are fabricated from materials such as dextran, gelatin, glass, or cellulose.

In some embodiments, industrial-scale processes are operated in continuous, semi-continuous or non-continuous modes. Non-limiting examples of operation modes are batch, fed batch, extended batch, repetitive batch, draw/fill, rotating-wall, spinning flask, and/or perfusion mode of operation. In some embodiments, a bioreactor allows continuous or semi-continuous replenishment of the substrate stock, for example a carbohydrate source and/or continuous or semi-continuous separation of the product, from the bioreactor.

In some embodiments, the bioreactor or fermentor includes a sensor and/or a control system to measure and/or adjust reaction parameters. Non-limiting examples of reaction parameters include biological parameters (e.g., growth rate, cell size, cell number, cell density, cell type, or cell state, etc.), chemical parameters (e.g., pH, redox-potential, concentration of reaction substrate and/or product, concentration of dissolved gases, such as oxygen concentration and $CO_2$ concentration, nutrient concentrations, metabolite concentrations, concentration of an oligopeptide, concentration of an amino acid, concentration of a vitamin, concentration of a hormone, concentration of an additive, serum concentration, ionic strength, concentration of an ion, relative humidity, molarity, osmolarity, concentration of other chemicals, for example buffering agents, adjuvants, or reaction by-products), physical/mechanical parameters (e.g., density, conductivity, degree of agitation, pressure, and flow rate, shear stress, shear rate, viscosity, color, turbidity, light absorption, mixing rate, conversion rate, as well as thermodynamic parameters, such as temperature, light intensity/quality, etc.). Sensors to measure the parameters described in this application are well known to one of ordinary skill in the relevant mechanical and electronic arts. Control systems to adjust the parameters in a bioreactor based on the inputs from a sensor described in this application are well known to one of ordinary skill in the art in bioreactor engineering.

In some embodiments, the method involves batch fermentation (e.g., shake flask fermentation). General considerations for batch fermentation (e.g., shake flask fermentation) include the level of oxygen and glucose. For example, batch fermentation (e.g., shake flask fermentation) may be oxygen and glucose limited, so in some embodiments, the capability of a strain to perform in a well-designed fed-batch fermentation is underestimated. Also, the final product (e.g., mogrol precursor, mogrol, mogroside precursor, or mogroside) may display some differences from the substrate (e.g., mogrol precursor, mogrol, mogroside precursor, or mogroside) in terms of solubility, toxicity, cellular accumulation and secretion and in some embodiments can have different fermentation kinetics.

The methods described in this application encompass production of the mogrol precursors (e.g., squalene, 2,3-oxidosqualene, or 24-25 epoxy-cucurbitadienol), mogrol, or mogrosides (e.g., MIA1, MIE1, MIIA1, MIIA2, MIIIA1, MIIE, MIII, siamenoside I, mogroside IV, isomogroside IV, MIIIE, and mogroside V) using a recombinant cell, cell lysate or isolated recombinant polypeptides (e.g., CDS, UGT, C11 hydroxylase, cytochrome P450 reductase, EPH, and squalene epoxidase).

Mogrol precursors (e.g., squalene, 2,3-oxidosqualene, or 24-25 epoxy-cucurbitadienol), mogrol, mogrosides (e.g., MIA1, MIE, MIIA1, MIIA2, MIIIA1, MIIE, MIII, siamenoside I, mogroside IV, isomogroside IV, MIIIE, and mogroside V) produced by any of the recombinant cells disclosed in this application may be identified and extracted using any method known in the art. Mass spectrometry (e.g., LC-MS, GC-MS) is a non-limiting example of a method for identification and may be used to help extract of a compound of interest.

The phraseology and terminology used in this application is for the purpose of description and should not be regarded as limiting. The use of terms such as "including," "comprising," "having," "containing," "involving," and/or variations thereof in this application, is meant to encompass the items listed thereafter and equivalents thereof as well as additional items.

The present invention is further illustrated by the following Examples, which in no way should be construed as further limiting. The entire contents of all of the references (including literature references, issued patents, published patent applications, and co pending patent applications) cited throughout this application are hereby expressly incorporated by reference.

EXAMPLES

Example 1. Identification and Functional Characterization of CDS Enzymes

A library of putative CDS enzymes was designed. The library included some oxidosqualene cyclase sequences that were modified to be more similar to CDSs.

Product made by a control strain expressing the *S. grosvenorii* CDS was identified as cucurbitadienol by NMR, and it was confirmed that hydroxylations of this product led to the production of mogrol. The putative CDS enzymes were evaluated to identify active enzyme(s) that catalyze cyclization of 2,3-oxidosqualene to cucurbitadienol. A total of 506 constructs from the putative CDS library were tested by transforming the library into an engineered *S. cerevisiae* screening strain. The *S. cerevisiae* screening strain comprised: a truncated HMG1 gene; overexpression of the ERG10, ERG13, ERG9, and ERG1 genes; and downregulation of the ERG7 gene. Genes encoding putative CDSs were expressed on a pESC-URA plasmid and expression was induced by culturing in SC-URA with 4% galactose. Cucurbitadienol was measured using GC-MS.

Forty CDSs were demonstrated to exhibit activity in the screen (Table 2). These CDSs included previously unidentified CDSs, as well as engineered CDSs. Some of the newly discovered enzymes showed as much as 2× or higher production of cucurbitadienol compared to the production of cucurbitadienol from a control strain that expressed a previously characterized CDS (SEQ ID NO: 73) from *S. grosvenorii*. SEQ ID NO: 33 is a non-limiting example of a polynucleotide sequence encoding SEQ ID NO: 73.

Therefore, various enzymes that can cyclize 2,3-oxidosqualene to cucurbitadienol have been identified and characterized.

TABLE 2

Cucurbitadienol Production by Putative CDS Enzymes.

| Name | Nucleotide Sequence | Amino Acid Sequence | cucurbitadienol (arbitrary units) |
| --- | --- | --- | --- |
| A0A0K9RW03_m | SEQ ID NO: 1 | SEQ ID NO: 41 | 0.194 |
| AquAgaCDS1_m | SEQ ID NO: 2 | SEQ ID NO: 42 | 0.005 |
| AquAgaCDS16 | SEQ ID NO: 3 | SEQ ID NO: 43 | 0.321 |
| AquAgaCDS6 | SEQ ID NO: 4 | SEQ ID NO: 44 | 0.501 |
| BenHisCDS2_m | SEQ ID NO: 5 | SEQ ID NO: 45 | 0.016 |
| A0A0D3QY32 | SEQ ID NO: 6 | SEQ ID NO: 46 | 0.551 |
| A0A0D3QXV2 | SEQ ID NO: 7 | SEQ ID NO: 47 | 0.384 |
| CmaCh17G013880.1 | SEQ ID NO: 8 | SEQ ID NO: 48 | 0.647 |
| A0A1S3CBF6 | SEQ ID NO: 9 | SEQ ID NO: 49 | 0.749 |
| CocGraCDS4 | SEQ ID NO: 10 | SEQ ID NO: 50 | 0.005 |
| CocGraCDS6_m | SEQ ID NO: 11 | SEQ ID NO: 51 | 0.032 |
| CSPI06G07180.1 | SEQ ID NO: 12 | SEQ ID NO: 52 | 0.456 |
| CucFoeCDS | SEQ ID NO: 13 | SEQ ID NO: 53 | 0.366 |
| CucMelMakCDS5 | SEQ ID NO: 14 | SEQ ID NO: 54 | 0.015 |
| CucMetCDS | SEQ ID NO: 15 | SEQ ID NO: 55 | 0.348 |
| CucPepOviCDS1_m | SEQ ID NO: 16 | SEQ ID NO: 56 | 0.007 |
| CucPepOviCDS2 | SEQ ID NO: 17 | SEQ ID NO: 57 | 0.004 |
| CucPepOviCDS3 | SEQ ID NO: 18 | SEQ ID NO: 58 | 0.006 |
| CucPepOviCDS3_m | SEQ ID NO: 19 | SEQ ID NO: 59 | 0.216 |
| Cucsa.349060.1 | SEQ ID NO: 20 | SEQ ID NO: 60 | 0.368 |
| F6GYI4 | SEQ ID NO: 21 | SEQ ID NO: 61 | 0.024 |
| GynCarCDS1 | SEQ ID NO: 22 | SEQ ID NO: 62 | 0.420 |
| GynCarCDS4 | SEQ ID NO: 23 | SEQ ID NO: 63 | 0.295 |
| K7NBZ9 | SEQ ID NO: 24 | SEQ ID NO: 64 | 0.158 |
| LagSicCDS2_m | SEQ ID NO: 25 | SEQ ID NO: 65 | 0.006 |
| Lus10014538.g_m | SEQ ID NO: 26 | SEQ ID NO: 66 | 0.321 |
| Lus10032146.g_m | SEQ ID NO: 27 | SEQ ID NO: 67 | 0.163 |
| MomChaCDS2 | SEQ ID NO: 28 | SEQ ID NO: 68 | 0.229 |
| MomChaCDS4 | SEQ ID NO: 29 | SEQ ID NO: 69 | 0.064 |
| O23909_PEA_Y118L | SEQ ID NO: 30 | SEQ ID NO: 70 | 0.067 |
| Q6BE24 | SEQ ID NO: 31 | SEQ ID NO: 71 | 0.063 |
| SecEduCDS | SEQ ID NO: 32 | SEQ ID NO: 72 | 0.284 |
| SgCDS1 | SEQ ID NO: 33 | SEQ ID NO: 73 | 0.245 |
| SgCDS_Scer1 | SEQ ID NO: 34 | SEQ ID NO: 74 | 0.857 |
| TriKirCDS10 | SEQ ID NO: 35 | SEQ ID NO: 75 | 0.178 |
| TriKirCDS4 | SEQ ID NO: 36 | SEQ ID NO: 76 | 0.269 |
| XP_006340479.1 | SEQ ID NO: 37 | SEQ ID NO: 77 | 0.073 |
| XP_008655662.1 | SEQ ID NO: 38 | SEQ ID NO: 78 | 0.021 |
| XP_010541955.1_m | SEQ ID NO: 39 | SEQ ID NO: 79 | 0.146 |
| XP_016688836.1_m | SEQ ID NO: 40 | SEQ ID NO: 80 | 0.003 |

It was concluded that the identified enzymes produced cucurbitadienol. GC-MS spectra of the product made by the newly discovered enzymes were very similar to cucurbitadienol produced with *S. grosvenorii* CDS in *S. cerevisiae*. This conclusion was confirmed with GC-MS, LC-MS and NMR. Cucurbitadienol made from these enzymes had a retention time, ionization pattern, and mass and fragmentation pattern identical to the cucurbitadienol made from the *S. grosvenorii* CDS.

Example 2. Identification and Functional Characterization of Putative UGT Enzymes This Example describes the design and screening of a UGT library to identify UGTs capable of converting mogrol and mogroside precursors into glycosylated mogrosides. Specifically, the library aimed to identify UGTs that glycosylate at the C3 and C24 hydroxyl groups of mogrol to yield mogrosides with different glucose units. A total of 1,059 putative UGTs were obtained.

To test the UGT library, an in vitro assay was developed. Plasmids carrying UGTs were transformed into *S. cerevisiae* CEN.PK ΔGAL80. The UGT library was screened in this assay using a total of 8 substrates: mogrol, mogroside I-A1, mogroside I-E1, mogroside II-A1, mogroside II-E, mogroside III, mogroside III-A1, and mogroside III-E. The cell lysates were incubated with 50 μM of substrate at 30° C. for 24 hours before being quenched. Product formation was tested by LC-MS after quenching the reactions. LC-MS profiles for mogrol and mogroside standards are shown in FIG. 2.

Figure 3A:
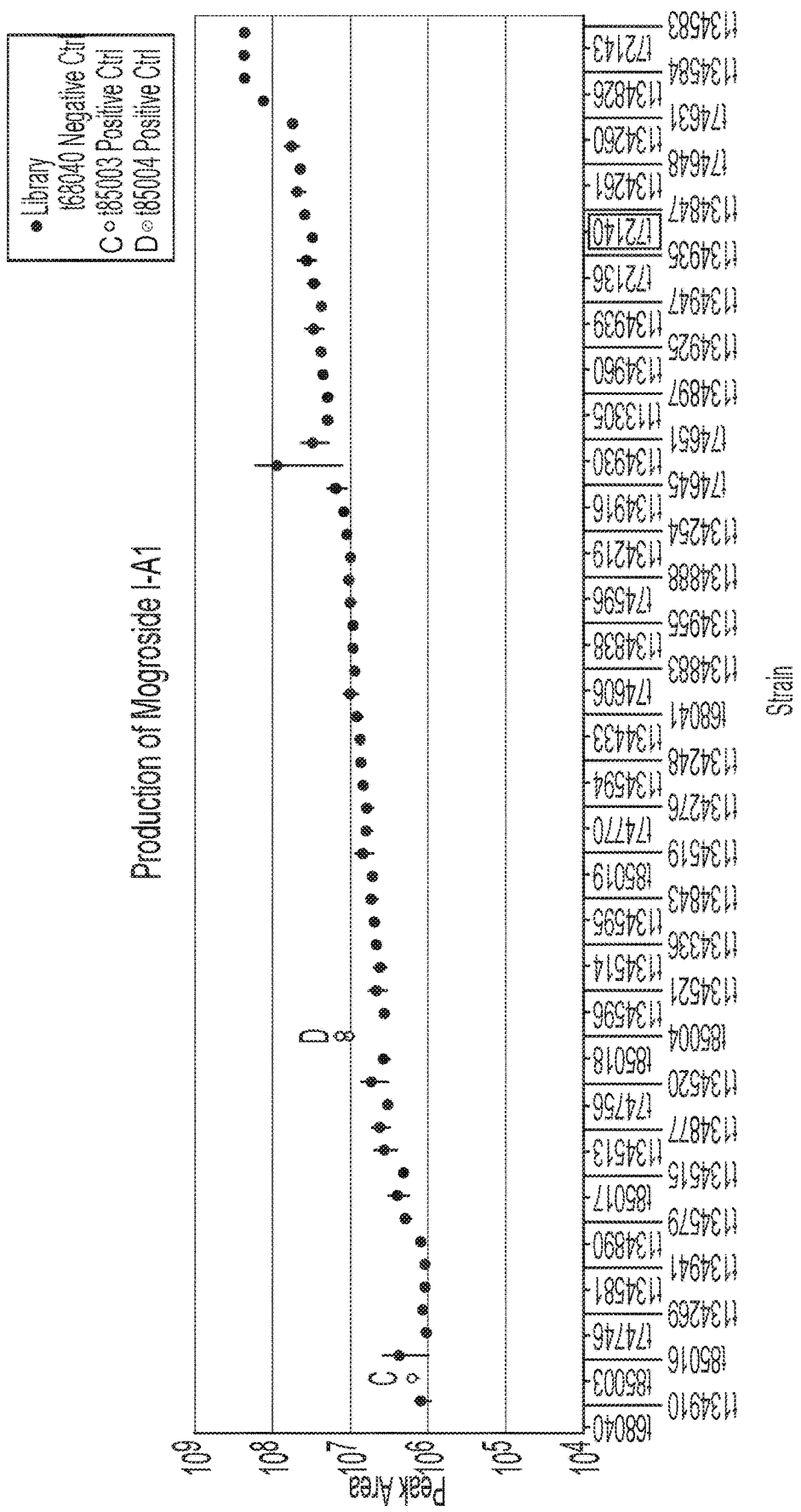
FIGS. 3A-3B include a series of graphs showing production of mogroside I-A1 (FIG. 3A) and siamenoside I (FIG. 3B) from a UGT library screened against mogroside substrates. Two biological replicates of each strain were screened.
Figure 3B:
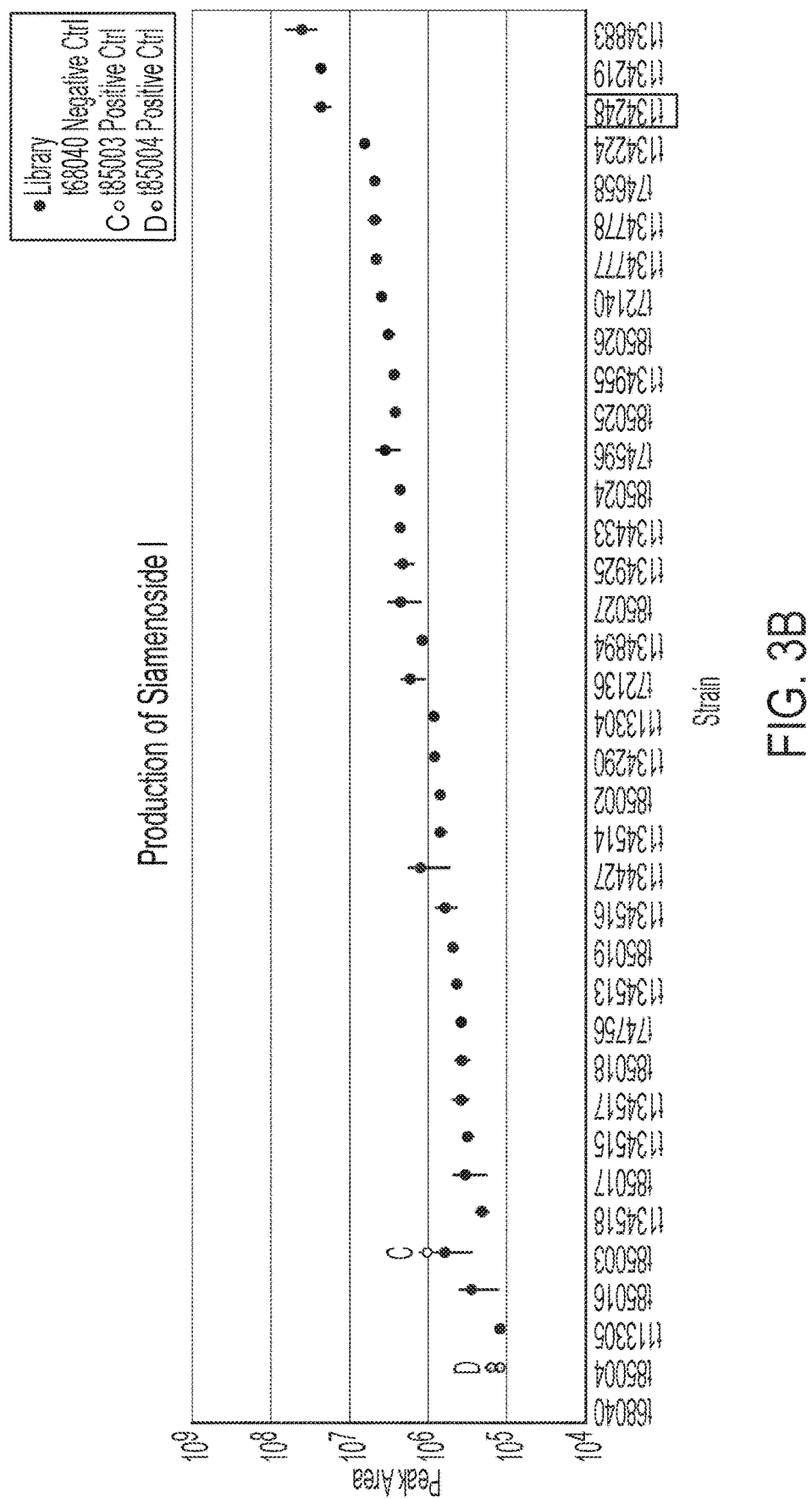
Figure 4A:
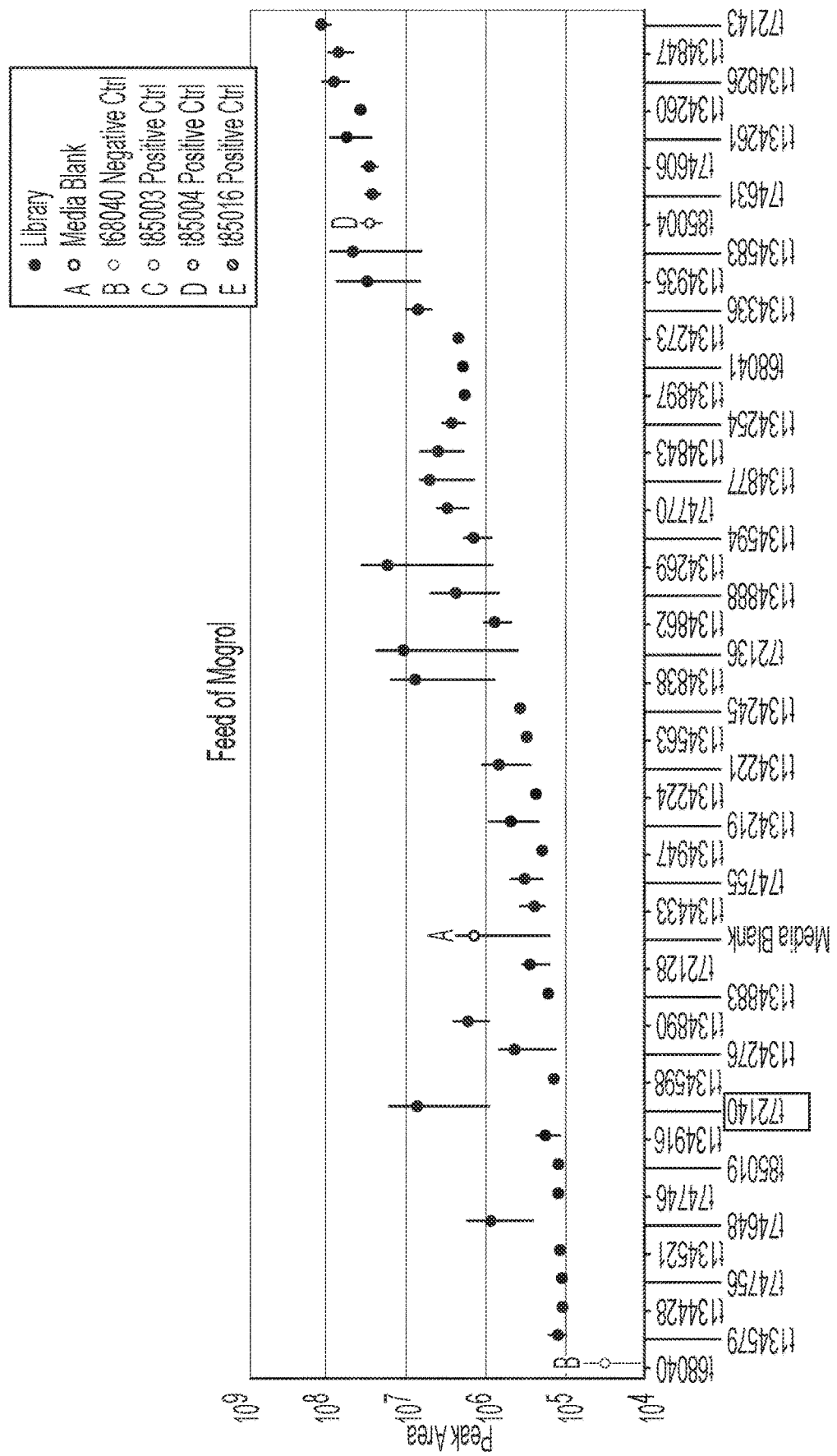
FIGS. 4A-4B include a series of graphs showing production of mogroside I-A1 from mogrol (FIG. 4A) and siamenoside I from mogroside III-A1 (FIG. 4B) in a secondary screen of hit strains on individual substrates. Two biological replicates with two technical replicates of each were screened for each hit strain.
Figure 4B:
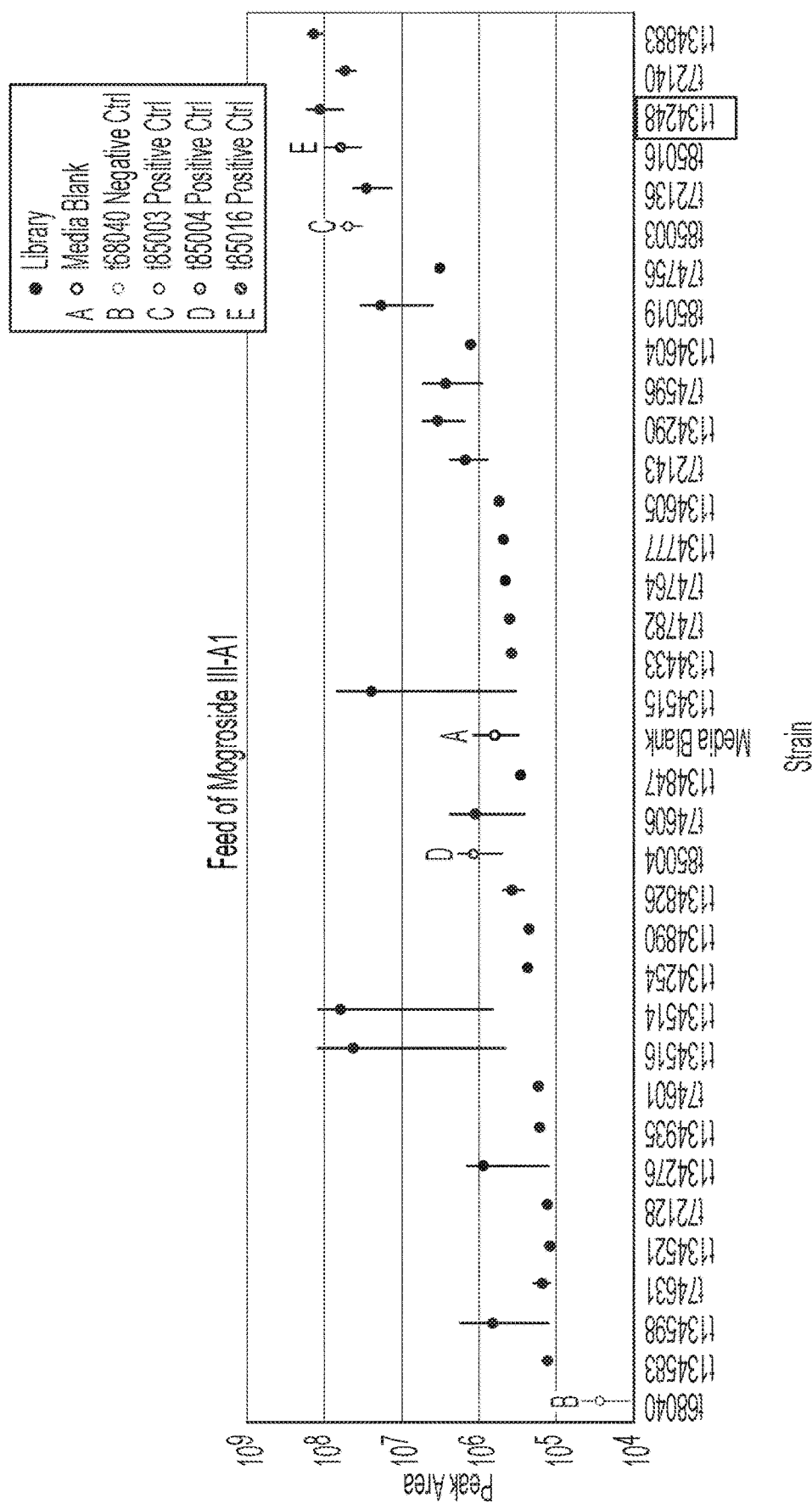

Based on this screen, UGTs were identified that could produce known mogroside products, including mogroside I-A1 and siamenoside I (FIGS. 3A-3B). Strains identified from this screen were then tested in an additional screen (FIGS. 4A-4B, Table 3).

TABLE 3

Product Formation by Putative UGTs

| Strain ID | Products made | UGT Nucleotide sequence | UGT Amino acid sequence | Product Formation (Peak area as measured by LC-MS, in arbitrary units) |
|---|---|---|---|---|
| t74693 | MI-A1 | SEQ ID NO: 81 | SEQ ID NO: 97 | 1.66E+08 |
| t74692 | MI-A1 | SEQ ID NO: 82 | SEQ ID NO: 98 | 5.62E+07 |
| t85004 | MI-A1 | SEQ ID NO: 83 | SEQ ID NO: 99 | 1.04E+07 |
| t85016 | MIE, MII-E, MIII, MIII-E, Siamenoside I | SEQ ID NO: 84 | SEQ ID NO: 100 | 6.14E+07, 3.37E+08, 1.93E+08, 2.21E+08, 2.59E+05 |
| t134826 | MI-A1, MII-A1 | SEQ ID NO: 85 | SEQ ID NO: 101 | 1.72E+08, 8.01E+06 |
| t72140 | MI-A1, MII-E, MIII, MIII-E, Siamenoside I | SEQ ID NO: 86 | SEQ ID NO: 102 | 3.09E+07, 3.79E+08, 2.14E+08, 2.28E+08, 5.69E+07 |
| t72143 | MI-A1, MII-A1, MIII | SEQ ID NO: 87 | SEQ ID NO: 103 | 1.21E+08, 4.24E+06, 1.18E+06 |
| t134583 | MII-E | SEQ ID NO: 88 | SEQ ID NO: 104 | 5.48E+08 |
| t85003 | MII-E, MIII, Siamenoside I | SEQ ID NO: 89 | SEQ ID NO: 105 | 5.70E+07, 8.73E+07, 7.77E+05 |
| t68041 | MI-A1, MIII-A1, MIII-E | SEQ ID NO: 90 | SEQ ID NO: 106 | 8.2E+06, 1.83E+07, 1.02E+08 |
| t74645 | MI-A1, MII-A1, MIII-A1, MIII-E | SEQ ID NO: 91 | SEQ ID NO: 107 | 1.55E+07, 3.07E+07, 1.9E+07, 4.24E+07 |
| t134883 | MII-E, MIII, Siamenoside I | SEQ ID NO: 92 | SEQ ID NO: 108 | 2.92E+08, 1.96E+08, 3.82E+07 |
| t85024 | MII-A1, MIII-E, MIII, Siamenoside I | SEQ ID NO: 93 | SEQ ID NO: 109 | 5.3E+07, 2.35E+06, 4.81E+07, 3.65E+06 |
| t134248 | MI-A1, MI-E, MII-E, MIII, Siamenoside I | SEQ ID NO: 94 | SEQ ID NO: 110 | 7.24E+06, 2.43E+07, 2.32E+08, 1.48E+08, 2.17E+07 |
| t74596 | Siamenoside I, MIII-E | SEQ ID NO: 95 | SEQ ID NO: 111 | 3.26E+06, 3.75E+07 |
| t134224 | Siamenoside I | SEQ ID NO: 96 | SEQ ID NO: 112 | 5.83E+06 |

Example 3. Further Characterization of UGTs 13 of the 16 UGTs identified from the screens described in Example 2 were expressed recombinantly in *E. coli* and purified using a 6×His tag. Protein concentrations of these purified UGTs were determined by Bradford assay. The specific activities of the 13 UGTs were determined by incubating 50 μM of each substrate with the UGTs for 5 min at 30° C. Reactions were quenched and product concentrations quantified by LC-MS (FIG. 4). Specific activities were calculated by dividing product concentration by the enzyme concentration and reaction time. The measured specific activities ranged from 0.01 to 5.53 mmol product/(g UGT*hr), with an average of 1.14.

Example 4. Protein Engineering of UGT94-289-1

The *S. cerevisiae* strain t85024 (expressing a recoded polynucleotide encoding UGT94-289-1) was observed to catalyze the 6-1 & 2-1 glycosylation reactions. However, this enzyme did not catalyze these reactions at a high rate.

Figure 5:
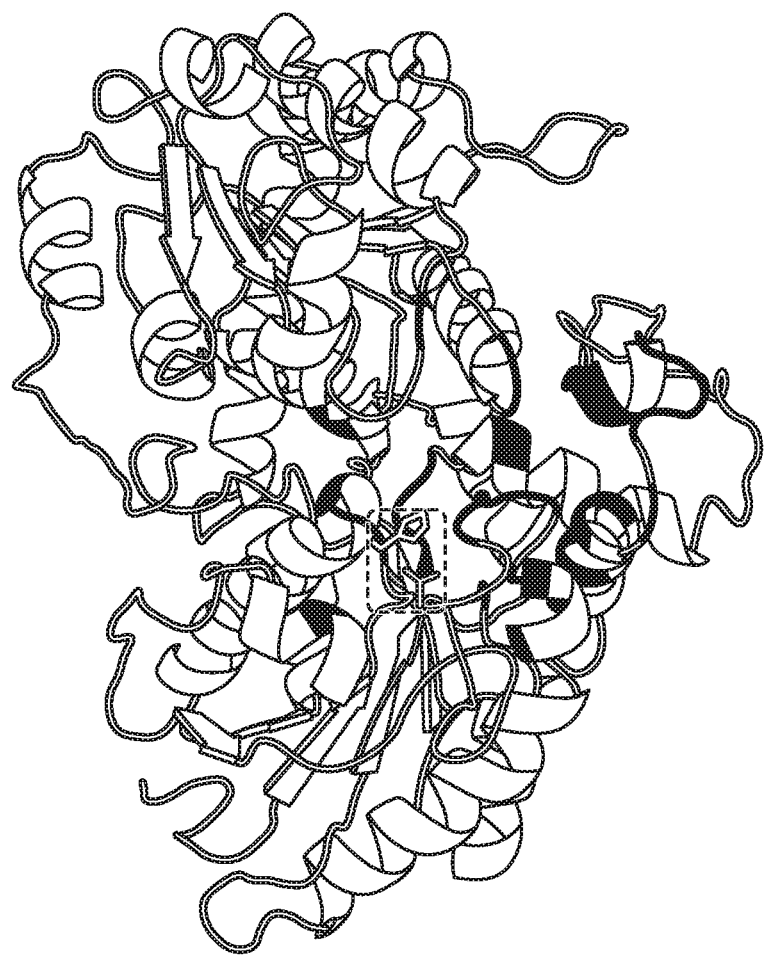
FIG. 5 is a schematic of a homology model of UGT94-289-1. Catalytic dyad side chains are shown within a box, and positions featuring activity enhancing mutations are highlighted in black.

A library of UGT sequences was designed in which each UGT sequence contained a single amino acid substitution relative to the UGT94-289-1 sequence. The library of UGT sequences was tested for enhanced activity of the 6-1 & 2-1 glycosylations. The library contained 893 members. The positions to mutate were chosen either based on their proximity (within 4.5 angstrom) to the catalytic dyad (His$^{21}$/Asp$^{122}$) or based on their predicted interactions with the substrate molecules. A homology model of UGT94-289-1 is shown in FIG. 5.

The 218 mutations that improved activity over the wild-type enzyme (UGT94-289-1) were identified through an in vitro screen (Table 4). Plasmids carrying the mutated UGT94-289-1 genes were transformed into *S. cerevisiae* CEN.PK ΔGAL80. To test the UGT mutation library, the in vitro assay from Example 2 was performed. A total of 3 substrates-mogroside II-A1, mogroside III and mogroside II-E—were tested with the UGT mutation library using this assay.

A number of mutations were identified that enhanced the activity of these glycosylation steps (Table 4). In Table 4, MIIA1 indicates mogroside II-A1, MIIE indicates mogroside II-E, MIIIA1 indicates mogroside III-A1, MIII indicates mogroside III, MIIIE indicates mogroside III-E, and Siam indicates siamenoside I. A subset of the UGTs containing mutations identified (N143V, N143I, L374N, L374Y, and L374W) were expressed and purified in *E. coli*. N143V, N143I, & L374N were found to enhance the specific activities for the reactions of mogroside II-A1 to mogroside III-A1 and mogroside III to siamenoside I by 4-8× and 12-16×, respectively, above the wild-type protein. L374Y and L374W were found to enhance the specific activity for the mogroside II-E to mogroside III-E reactions by 13× and 28×, respectively, above wild-type. These observations generally match the data observed in the *S. cerevisiae* screen (Table 4). Additionally, the N143V mutation was observed to produce mogroside V from siamenoside which is an activity not observed in the wild-type UGT or the other mutants.

Non-limiting examples of structural motifs in UGT94-289-1 and the sequences of the structural motifs are shown in Table 5.

TABLE 4

UGT94-289-1 Substitution Mutations

| Name | Mutation | Substrate | Product | Fold Increase | Location |
|---|---|---|---|---|---|
| UGT94-289-1 S123A | S123A | MIII | Siam | 2.273 | loop 8 |
| UGT94-289-1 S123C | S123C | MIIA1 | MIIIA1 | 2.638 | loop 8 |
| UGT94-289-1 S123G | S123G | MIII | Siam | 2.242 | loop 8 |
| UGT94-289-1 S123G | S123G | MIIA1 | MIIIA1 | 2.65 | loop 8 |
| UGT94-289-1 S123V | S123V | MIIA1 | MIIIA1 | 8.144 | loop 8 |
| UGT94-289-1 S123V | S123V | MIIE | MIIIE | 2.647 | loop 8 |
| UGT94-289-1 F124Y | F124Y | MIIE | MIII | 1.57 | loop 8 |
| UGT94-289-1 N143A | N143A | MIIE | MIIIE | 1.938 | beta sheet 5 |
| UGT94-289-1 N143C | N143C | MIIE | MIIIE | 6.117 | beta sheet 5 |
| UGT94-289-1 N143C | N143C | MIII | Siam | 5.461 | beta sheet 5 |
| UGT94-289-1 N143E | N143E | MIIE | MIIIE | 2.553 | beta sheet 5 |
| UGT94-289-1 N143I | N143I | MIIE | MIIIE | 21.423 | beta sheet 5 |
| UGT94-289-1 N143I | N143I | MIII | Siam | 7.092 | beta sheet 5 |
| UGT94-289-1 N143L | N143L | MIIE | MIIIE | 10.417 | beta sheet 5 |
| UGT94-289-1 N143L | N143L | MIII | Siam | 5.495 | beta sheet 5 |
| UGT94-289-1 N143M | N143M | MIIE | MIIIE | 1.82 | beta sheet 5 |
| UGT94-289-1 N143M | N143M | MIII | Siam | 3.51 | beta sheet 5 |
| UGT94-289-1 N143Q | N143Q | MIIE | MIIIE | 2.27 | beta sheet 5 |
| UGT94-289-1 N143Q | N143Q | MIII | Siam | 4.59 | beta sheet 5 |
| UGT94-289-1 N143S | N143S | MIIE | MIIIE | 4.88 | beta sheet 5 |
| UGT94-289-1 N143S | N143S | MIII | Siam | 8.245 | beta sheet 5 |
| UGT94-289-1 N143T | N143T | MIII | Siam | 4.063 | beta sheet 5 |
| UGT94-289-1 N143V | N143V | MIIE | MIIIE | 18.199 | beta sheet 5 |
| UGT94-289-1 N143V | N143V | MIII | Siam | 15.741 | beta sheet 5 |
| UGT94-289-1 T144A | T144A | MIIE | MIIIE | 1.761 | loop 10 |

TABLE 4-continued

UGT94-289-1 Substitution Mutations

| Name | Mutation | Substrate | Product | Fold Increase | Location |
|---|---|---|---|---|---|
| UGT94-289-1 T144C | T144C | MIIE | MIIIE | 1.95 | loop 10 |
| UGT94-289-1 T144N | T144N | MIIE | MIIIE | 1.767 | loop 10 |
| UGT94-289-1 T144P | T144P | MIIE | MIIIE | 5.457 | loop 10 |
| UGT94-289-1 T145A | T145A | MIIE | MIIIE | 5.23 | loop 10 |
| UGT94-289-1 T145A | T145A | MIII | Siam | 3.754 | loop 10 |
| UGT94-289-1 T145C | T145C | MIIE | MIIIE | 12.959 | loop 10 |
| UGT94-289-1 T145C | T145C | MIII | Siam | 8.76 | loop 10 |
| UGT94-289-1 T145G | T145G | MIIE | MIII | 2.028 | loop 10 |
| UGT94-289-1 T145G | T145G | MIIE | MIIIE | 6.34 | loop 10 |
| UGT94-289-1 T145G | T145G | MIII | Siam | 3.912 | loop 10 |
| UGT94-289-1 T145M | T145M | MIIE | MIIIE | 2.614 | loop 10 |
| UGT94-289-1 T145N | T145N | MIIE | MIIIE | 2.716 | loop 10 |
| UGT94-289-1 T145Q | T145Q | MIIE | MIIIE | 2.561 | loop 10 |
| UGT94-289-1 T145S | T145S | MIIE | MIIIE | 7.897 | loop 10 |
| UGT94-289-1 T145S | T145S | MIII | Siam | 1.871 | loop 10 |
| UGT94-289-1 V149C | V149C | MIIE | MIII | 1.694 | alpha helix 5 |
| UGT94-289-1 V149L | V149L | MIIA1 | MIIIA1 | 2.184 | alpha helix 5 |
| UGT94-289-1 V149M | V149M | MIIA1 | MIIIA1 | 3.64 | alpha helix 5 |
| UGT94-289-1 V149M | V149M | MIIE | MIII | 1.527 | alpha helix 5 |
| UGT94-289-1 Y179E | Y179E | MIIE | MIIIE | 1.938 | loop 11 |
| UGT94-289-1 Y179F | Y179F | MIIE | MIIIE | 4.775 | loop 11 |
| UGT94-289-1 Y179H | Y179H | MIIE | MIIIE | 2.638 | loop 11 |
| UGT94-289-1 Y179I | Y179I | MIIE | MIIIE | 4.185 | loop 11 |
| UGT94-289-1 Y179K | Y179K | MIIE | MIIIE | 1.758 | loop 11 |
| UGT94-289-1 Y179L | Y179L | MIIE | MIIIE | 2.424 | loop 11 |
| UGT94-289-1 Y179V | Y179V | MIIE | MIIIE | 1.789 | loop 11 |
| UGT94-289-1 Y179W | Y179W | MIIE | MIIIE | 11.719 | loop 11 |
| UGT94-289-1 G18S | G18S | MIIE | MIII | 1.835 | loop 2 |
| UGT94-289-1 S180A | S180A | MIIE | MIIIE | 1.749 | alpha helix 6 |
| UGT94-289-1 S180V | S180V | MIIE | MIIIE | 2.056 | alpha helix 6 |
| UGT94-289-1 A181K | A181K | MIIE | MIII | 1.813 | alpha helix 6 |
| UGT94-289-1 A181T | A181T | MIII | Siam | 2.369 | alpha helix 6 |
| UGT94-289-1 G184A | G184A | MIIA1 | MIIIA1 | 3.983 | loop 12 |
| UGT94-289-1 G184A | G184A | MIIE | MIII | 1.716 | loop 12 |
| UGT94-289-1 G184C | G184C | MIIA1 | MIIIA1 | 7.234 | loop 12 |
| UGT94-289-1 G184C | G184C | MIIE | MIII | 1.553 | loop 12 |
| UGT94-289-1 G184D | G184D | MIIA1 | MIIIA1 | 4.47 | loop 12 |

TABLE 4-continued

UGT94-289-1 Substitution Mutations

| Name | Mutation | Substrate | Product | Fold Increase | Location |
|---|---|---|---|---|---|
| UGT94-289-1 G184D | G184D | MIIE | MIII | 1.584 | loop 12 |
| UGT94-289-1 G184E | G184E | MIIA1 | MIIIA1 | 9.996 | loop 12 |
| UGT94-289-1 G184E | G184E | MIIE | MIII | 1.622 | loop 12 |
| UGT94-289-1 G184F | G184F | MIIA1 | MIIIA1 | 3.598 | loop 12 |
| UGT94-289-1 G184H | G184H | MIII | Siam | 6.765 | loop 12 |
| UGT94-289-1 G184H | G184H | MIIA1 | MIIIA1 | 6.995 | loop 12 |
| UGT94-289-1 G184I | G184I | MIIA1 | MIIIA1 | 2.404 | loop 12 |
| UGT94-289-1 G184K | G184K | MIIA1 | MIIIA1 | 2.887 | loop 12 |
| UGT94-289-1 G184M | G184M | MIIA1 | MIIIA1 | 4.016 | loop 12 |
| UGT94-289-1 G184M | G184M | MIIE | MIII | 1.6 | loop 12 |
| UGT94-289-1 G184N | G184N | MIII | Siam | 3.221 | loop 12 |
| UGT94-289-1 G184N | G184N | MIIA1 | MIIIA1 | 5.854 | loop 12 |
| UGT94-289-1 G184N | G184N | MIIE | MIII | 1.742 | loop 12 |
| UGT94-289-1 G184P | G184P | MIIA1 | MIIIA1 | 4.867 | loop 12 |
| UGT94-289-1 G184Q | G184Q | MIIA1 | MIIIA1 | 2.694 | loop 12 |
| UGT94-289-1 G184Q | G184Q | MIIE | MIII | 1.636 | loop 12 |
| UGT94-289-1 G184R | G184R | MIII | Siam | 2.878 | loop 12 |
| UGT94-289-1 G184R | G184R | MIIA1 | MIIIA1 | 8.334 | loop 12 |
| UGT94-289-1 G184S | G184S | MIII | Siam | 2.168 | loop 12 |
| UGT94-289-1 G184S | G184S | MIIA1 | MIIIA1 | 4.5 | loop 12 |
| UGT94-289-1 G184S | G184S | MIIE | MIII | 1.679 | loop 12 |
| UGT94-289-1 G184T | G184T | MIII | Siam | 3.025 | loop 12 |
| UGT94-289-1 G184T | G184T | MIIA1 | MIIIA1 | 8.905 | loop 12 |
| UGT94-289-1 G184T | G184T | MIIE | MIII | 1.637 | loop 12 |
| UGT94-289-1 G184Y | G184Y | MIIA1 | MIIIA1 | 2.622 | loop 12 |
| UGT94-289-1 A185C | A185C | MIIA1 | MIIIA1 | 5.499 | loop 12 |
| UGT94-289-1 A185C | A185C | MIIE | MIII | 1.539 | loop 12 |
| UGT94-289-1 A185D | A185D | MIIA1 | MIIIA1 | 6.866 | loop 12 |
| UGT94-289-1 A185D | A185D | MIIE | MIII | 1.637 | loop 12 |
| UGT94-289-1 A185E | A185E | MIII | Siam | 2.09 | loop 12 |
| UGT94-289-1 A185E | A185E | MIIA1 | MIIIA1 | 12.017 | loop 12 |
| UGT94-289-1 A185G | A185G | MIII | Siam | 3.325 | loop 12 |
| UGT94-289-1 A185G | A185G | MIIA1 | MIIIA1 | 5.983 | loop 12 |
| UGT94-289-1 A185G | A185G | MIIE | MIII | 1.516 | loop 12 |
| UGT94-289-1 A185K | A185K | MIIA1 | MIIIA1 | 7.428 | loop 12 |
| UGT94-289-1 A185L | A185L | MIIA1 | MIIIA1 | 3.769 | loop 12 |
| UGT94-289-1 A185M | A185M | MIII | Siam | 8.417 | loop 12 |
| UGT94-289-1 A185M | A185M | MIIA1 | MIIIA1 | 2.573 | loop 12 |
| UGT94-289-1 A185N | A185N | MIIA1 | MIIIA1 | 4.856 | loop 12 |
| UGT94-289-1 A185N | A185N | MIIE | MIII | 1.563 | loop 12 |
| UGT94-289-1 A185P | A185P | MIIE | MIII | 1.826 | loop 12 |
| UGT94-289-1 A185Q | A185Q | MIIA1 | MIIIA1 | 4.761 | loop 12 |
| UGT94-289-1 A185Q | A185Q | MIIE | MIII | 1.684 | loop 12 |
| UGT94-289-1 A185T | A185T | MIII | Siam | 2.518 | loop 12 |
| UGT94-289-1 A185W | A185W | MIIA1 | MIIIA1 | 3.44 | loop 12 |
| UGT94-289-1 A185Y | A185Y | MIII | Siam | 3.144 | loop 12 |
| UGT94-289-1 A185Y | A185Y | MIIA1 | MIIIA1 | 5.306 | loop 12 |
| UGT94-289-1 V186A | V186A | MIII | Siam | 2.219 | loop 12 |
| UGT94-289-1 V186A | V186A | MIIA1 | MIIIA1 | 4.301 | loop 12 |
| UGT94-289-1 V186C | V186C | MIII | Siam | 4.819 | loop 12 |
| UGT94-289-1 V186C | V186C | MIIA1 | MIIIA1 | 4.066 | loop 12 |
| UGT94-289-1 V186D | V186D | MIII | Siam | 4.792 | loop 12 |
| UGT94-289-1 V186D | V186D | MIIA1 | MIIIA1 | 13.5 | loop 12 |
| UGT94-289-1 V186E | V186E | MIII | Siam | 3.432 | loop 12 |
| UGT94-289-1 V186E | V186E | MIIA1 | MIIIA1 | 11.923 | loop 12 |
| UGT94-289-1 V186G | V186G | MIII | Siam | 3.306 | loop 12 |
| UGT94-289-1 V186G | V186G | MIIA1 | MIIIA1 | 9.872 | loop 12 |
| UGT94-289-1 V186I | V186I | MIIA1 | MIIIA1 | 4.387 | loop 12 |
| UGT94-289-1 V186K | V186K | MIIA1 | MIIIA1 | 8.032 | loop 12 |
| UGT94-289-1 V186L | V186L | MIIA1 | MIIIA1 | 7.942 | loop 12 |
| UGT94-289-1 V186M | V186M | MIII | Siam | 2.802 | loop 12 |
| UGT94-289-1 V186M | V186M | MIIA1 | MIIIA1 | 4.086 | loop 12 |
| UGT94-289-1 V186N | V186N | MIII | Siam | 3.065 | loop 12 |
| UGT94-289-1 V186N | V186N | MIIA1 | MIIIA1 | 4.147 | loop 12 |
| UGT94-289-1 V186P | V186P | MIIA1 | MIIIA1 | 3.081 | loop 12 |
| UGT94-289-1 V186Q | V186Q | MIIA1 | MIIIA1 | 4.422 | loop 12 |
| UGT94-289-1 V186R | V186R | MIIA1 | MIIIA1 | 6.415 | loop 12 |
| UGT94-289-1 V186T | V186T | MIIA1 | MIIIA1 | 3.906 | loop 12 |
| UGT94-289-1 V186W | V186W | MIIA1 | MIIIA1 | 5.795 | loop 12 |
| UGT94-289-1 V186Y | V186Y | MIII | Siam | 4.752 | loop 12 |
| UGT94-289-1 V186Y | V186Y | MIIA1 | MIIIA1 | 3.708 | loop 12 |
| UGT94-289-1 T187A | T187A | MIIA1 | MIIIA1 | 4.249 | loop 12 |
| UGT94-289-1 T187A | T187A | MIIE | MIII | 1.553 | loop 12 |
| UGT94-289-1 T187C | T187C | MIIA1 | MIIIA1 | 2.811 | loop 12 |

TABLE 4-continued

UGT94-289-1 Substitution Mutations

| Name | Mutation | Substrate | Product | Fold Increase | Location |
|---|---|---|---|---|---|
| UGT94-289-1 T187D | T187D | MIII | Siam | 2.168 | loop 12 |
| UGT94-289-1 T187D | T187D | MIIA1 | MIIIA1 | 6.58 | loop 12 |
| UGT94-289-1 T187D | T187D | MIIE | MIII | 1.491 | loop 12 |
| UGT94-289-1 T187E | T187E | MIII | Siam | 2.791 | loop 12 |
| UGT94-289-1 T187E | T187E | MIIA1 | MIIIA1 | 8.267 | loop 12 |
| UGT94-289-1 T187G | T187G | MIIA1 | MIIIA1 | 4.922 | loop 12 |
| UGT94-289-1 T187H | T187H | MIIA1 | MIIIA1 | 2.132 | loop 12 |
| UGT94-289-1 T187I | T187I | MIIA1 | MIIIA1 | 6.307 | loop 12 |
| UGT94-289-1 T187K | T187K | MIIA1 | MIIIA1 | 7.08 | loop 12 |
| UGT94-289-1 T187L | T187L | MIIA1 | MIIIA1 | 2.089 | loop 12 |
| UGT94-289-1 T187N | T187N | MIIA1 | MIIIA1 | 8.746 | loop 12 |
| UGT94-289-1 T187N | T187N | MIIE | MIII | 1.521 | loop 12 |
| UGT94-289-1 T187P | T187P | MIIA1 | MIIIA1 | 2.958 | loop 12 |
| UGT94-289-1 T187R | T187R | MIII | Siam | 3.005 | loop 12 |
| UGT94-289-1 T187S | T187S | MIIA1 | MIIIA1 | 8.98 | loop 12 |
| UGT94-289-1 T187V | T187V | MIIA1 | MIIIA1 | 4.438 | loop 12 |
| UGT94-289-1 T187V | T187V | MIIE | MIII | 1.603 | loop 12 |
| UGT94-289-1 T187W | T187W | MIIA1 | MIIIA1 | 4.221 | loop 12 |
| UGT94-289-1 T187Y | T187Y | MIIA1 | MIIIA1 | 6.997 | loop 12 |
| UGT94-289-1 K189A | K189A | MIIA1 | MIIIA1 | 3.76 | loop 12 |
| UGT94-289-1 K189C | K189C | MIIA1 | MIIIA1 | 3.644 | loop 12 |
| UGT94-289-1 K189C | K189C | MIIE | MIII | 1.517 | loop 12 |
| UGT94-289-1 K189D | K189D | MIIA1 | MIIIA1 | 8.394 | loop 12 |
| UGT94-289-1 K189E | K189E | MIII | Siam | 3.191 | loop 12 |
| UGT94-289-1 K189E | K189E | MIIA1 | MIIIA1 | 13.432 | loop 12 |
| UGT94-289-1 K189F | K189F | MIIA1 | MIIIA1 | 7.263 | loop 12 |
| UGT94-289-1 K189G | K189G | MIIA1 | MIIIA1 | 8.815 | loop 12 |
| UGT94-289-1 K189G | K189G | MIIE | MIII | 1.507 | loop 12 |
| UGT94-289-1 K189H | K189H | MIIA1 | MIIIA1 | 4.797 | loop 12 |
| UGT94-289-1 K189I | K189I | MIII | Siam | 3.884 | loop 12 |
| UGT94-289-1 K189I | K189I | MIIA1 | MIIIA1 | 2.721 | loop 12 |
| UGT94-289-1 K189L | K189L | MIII | Siam | 2.147 | loop 12 |
| UGT94-289-1 K189L | K189L | MIIA1 | MIIIA1 | 3.223 | loop 12 |
| UGT94-289-1 K189M | K189M | MIIA1 | MIIIA1 | 6.412 | loop 12 |
| UGT94-289-1 K189P | K189P | MIIA1 | MIIIA1 | 7.946 | loop 12 |
| UGT94-289-1 K189P | K189P | MIIE | MIII | 1.652 | loop 12 |
| UGT94-289-1 K189Q | K189Q | MIIA1 | MIIIA1 | 3.396 | loop 12 |
| UGT94-289-1 K189R | K189R | MIIA1 | MIIIA1 | 3.389 | loop 12 |
| UGT94-289-1 K189S | K189S | MIIA1 | MIIIA1 | 6.478 | loop 12 |
| UGT94-289-1 K189T | K189T | MIIA1 | MIIIA1 | 4.682 | loop 12 |
| UGT94-289-1 K189T | K189T | MIIE | MIII | 1.698 | loop 12 |
| UGT94-289-1 K189V | K189V | MIII | Siam | 2.113 | loop 12 |
| UGT94-289-1 K189V | K189V | MIIA1 | MIIIA1 | 6.123 | loop 12 |
| UGT94-289-1 K189W | K189W | MIIA1 | MIIIA1 | 2.618 | loop 12 |
| UGT94-289-1 K189Y | K189Y | MIII | Siam | 6.908 | loop 12 |
| UGT94-289-1 Y19F | Y19F | MIIE | MIII | 1.698 | alpha helix 1 |
| UGT94-289-1 Y19H | Y19H | MIIE | MIII | 1.722 | alpha helix 1 |
| UGT94-289-1 Y19L | Y19L | MIIE | MIII | 1.729 | alpha helix 1 |
| UGT94-289-1 Y19V | Y19V | MIIE | MIII | 1.71 | alpha helix 1 |
| UGT94-289-1 H191A | H191A | MIIA1 | MIIIA1 | 3.948 | alpha helix 7 |
| UGT94-289-1 H191A | H191A | MIIE | MIII | 1.516 | alpha helix 7 |
| UGT94-289-1 H191C | H191C | MIII | Siam | 3.642 | alpha helix 7 |
| UGT94-289-1 H191C | H191C | MIIA1 | MIIIA1 | 2.165 | alpha helix 7 |
| UGT94-289-1 H191D | H191D | MIII | Siam | 7.793 | alpha helix 7 |
| UGT94-289-1 H191D | H191D | MIIA1 | MIIIA1 | 4.048 | alpha helix 7 |
| UGT94-289-1 H191E | H191E | MIII | Siam | 5.036 | alpha helix 7 |
| UGT94-289-1 H191E | H191E | MIIA1 | MIIIA1 | 2.556 | alpha helix 7 |
| UGT94-289-1 H191E | H191E | MIIE | MIII | 1.658 | alpha helix 7 |
| UGT94-289-1 H191G | H191G | MIII | Siam | 6.242 | alpha helix 7 |
| UGT94-289-1 H191G | H191G | MIIA1 | MIIIA1 | 2.545 | alpha helix 7 |
| UGT94-289-1 H191K | H191K | MIII | Siam | 2.368 | alpha helix 7 |
| UGT94-289-1 H191M | H191M | MIIA1 | MIIIA1 | 4.329 | alpha helix 7 |
| UGT94-289-1 H191M | H191M | MIIE | MIII | 1.524 | alpha helix 7 |
| UGT94-289-1 H191P | H191P | MIII | Siam | 2.243 | alpha helix 7 |
| UGT94-289-1 H191P | H191P | MIIA1 | MIIIA1 | 5.514 | alpha helix 7 |
| UGT94-289-1 H191P | H191P | MIIE | MIII | 1.615 | alpha helix 7 |
| UGT94-289-1 H191Q | H191Q | MIII | Siam | 6.511 | alpha helix 7 |
| UGT94-289-1 H191S | H191S | MIII | Siam | 3.466 | alpha helix 7 |
| UGT94-289-1 H191T | H191T | MIII | Siam | 5.821 | alpha helix 7 |
| UGT94-289-1 H191T | H191T | MIIA1 | MIIIA1 | 2.299 | alpha helix 7 |
| UGT94-289-1 H191V | H191V | MIII | Siam | 5.918 | alpha helix 7 |
| UGT94-289-1 H191W | H191W | MIII | Siam | 3.457 | alpha helix 7 |
| UGT94-289-1 H191Y | H191Y | MIII | Siam | 2.129 | alpha helix 7 |
| UGT94-289-1 K192C | K192C | MIIE | MIII | 1.547 | alpha helix 7 |

TABLE 4-continued

UGT94-289-1 Substitution Mutations

| Name | Mutation | Substrate | Product | Fold Increase | Location |
|---|---|---|---|---|---|
| UGT94-289-1 K192F | K192F | MIIE | MIII | 1.579 | alpha helix 7 |
| UGT94-289-1 G194D | G194D | MIII | Siam | 2.477 | alpha helix 7 |
| UGT94-289-1 G194L | G194L | MIIE | MIII | 1.502 | alpha helix 7 |
| UGT94-289-1 G194M | G194M | MIIA1 | MIIIA1 | 2.722 | alpha helix 7 |
| UGT94-289-1 G194N | G194N | MIII | Siam | 2.165 | alpha helix 7 |
| UGT94-289-1 G194P | G194P | MIII | Siam | 3.154 | alpha helix 7 |
| UGT94-289-1 G194P | G194P | MIIE | MIII | 1.658 | alpha helix 7 |
| UGT94-289-1 G194S | G194S | MIIA1 | MIIIA1 | 2.15 | alpha helix 7 |
| UGT94-289-1 G194W | G194W | MIIE | MIII | 1.659 | alpha helix 7 |
| UGT94-289-1 E195A | E195A | MIII | Siam | 2.4 | alpha helix 7 |
| UGT94-289-1 E195I | E195I | MIII | Siam | 2.417 | alpha helix 7 |
| UGT94-289-1 E195K | E195K | MIII | Siam | 2.833 | alpha helix 7 |
| UGT94-289-1 E195L | E195L | MIII | Siam | 2.204 | alpha helix 7 |
| UGT94-289-1 E195N | E195N | MIIA1 | MIIIA1 | 2.471 | alpha helix 7 |
| UGT94-289-1 E195Q | E195Q | MIIA1 | MIIIA1 | 3.857 | alpha helix 7 |
| UGT94-289-1 E195S | E195S | MIII | Siam | 4.615 | alpha helix 7 |
| UGT94-289-1 E195T | E195T | MIIE | MIII | 1.703 | alpha helix 7 |
| UGT94-289-1 E195Y | E195Y | MIIA1 | MIIIA1 | 4.587 | alpha helix 7 |
| UGT94-289-1 A198C | A198C | MIII | Siam | 5.14 | alpha helix 7 |
| UGT94-289-1 A198D | A198D | MIII | Siam | 2.683 | alpha helix 7 |
| UGT94-289-1 A198E | A198E | MIII | Siam | 10.705 | alpha helix 7 |
| UGT94-289-1 A198E | A198E | MIIA1 | MIIIA1 | 2.252 | alpha helix 7 |
| UGT94-289-1 A198F | A198F | MIII | Siam | 5.788 | alpha helix 7 |
| UGT94-289-1 A198H | A198H | MIII | Siam | 5.034 | alpha helix 7 |
| UGT94-289-1 A198I | A198I | MIII | Siam | 33.382 | alpha helix 7 |
| UGT94-289-1 A198I | A198I | MIIA1 | MIIIA1 | 6.961 | alpha helix 7 |
| UGT94-289-1 A198K | A198K | MIIA1 | MIIIA1 | 4.659 | alpha helix 7 |
| UGT94-289-1 A198L | A198L | MIII | Siam | 5.588 | alpha helix 7 |
| UGT94-289-1 A198L | A198L | MIIA1 | MIIIA1 | 3.686 | alpha helix 7 |
| UGT94-289-1 A198L | A198L | MIIE | MIII | 1.921 | alpha helix 7 |
| UGT94-289-1 A198M | A198M | MIII | Siam | 11.449 | alpha helix 7 |
| UGT94-289-1 A198M | A198M | MIIA1 | MIIIA1 | 3.35 | alpha helix 7 |
| UGT94-289-1 A198N | A198N | MIII | Siam | 5.886 | alpha helix 7 |
| UGT94-289-1 A198N | A198N | MIIA1 | MIIIA1 | 3.978 | alpha helix 7 |
| UGT94-289-1 A198P | A198P | MIII | Siam | 3.242 | alpha helix 7 |
| UGT94-289-1 A198Q | A198Q | MIIA1 | MIIIA1 | 10.477 | alpha helix 7 |
| UGT94-289-1 A198Q | A198Q | MIIE | MIII | 1.582 | alpha helix 7 |
| UGT94-289-1 A198R | A198R | MIII | Siam | 7.871 | alpha helix 7 |
| UGT94-289-1 A198R | A198R | MIIA1 | MIIIA1 | 2.876 | alpha helix 7 |
| UGT94-289-1 A198S | A198S | MIII | Siam | 5.022 | alpha helix 7 |
| UGT94-289-1 A198S | A198S | MIIA1 | MIIIA1 | 2.141 | alpha helix 7 |
| UGT94-289-1 A198T | A198T | MIII | Siam | 9.938 | alpha helix 7 |
| UGT94-289-1 A198V | A198V | MIII | Siam | 6.579 | alpha helix 7 |
| UGT94-289-1 A198V | A198V | MIIA1 | MIIIA1 | 4.21 | alpha helix 7 |
| UGT94-289-1 A198Y | A198Y | MIIA1 | MIIIA1 | 3.296 | alpha helix 7 |
| UGT94-289-1 A198Y | A198Y | MIIE | MIII | 1.585 | alpha helix 7 |
| UGT94-289-1 F276C | F276C | MIIE | MIII | 1.889 | loop 18 |
| UGT94-289-1 F276Q | F276Q | MIIE | MIII | 2.273 | loop 18 |
| UGT94-289-1 F276Q | F276Q | MIIE | MIIIE | 1.696 | loop 18 |
| UGT94-289-1 N355Q | N355Q | MIIE | MIIIE | 2.164 | alpha helix 14 |
| UGT94-289-1 N355S | N355S | MIIE | MIII | 2.126 | alpha helix 14 |
| UGT94-289-1 N355S | N355S | MIIE | MIIIE | 2.703 | alpha helix 14 |
| UGT94-289-1 H373K | H373K | MIIE | MIIIE | 2.226 | loop 26 |
| UGT94-289-1 H373L | H373L | MIIE | MIIIE | 1.73 | loop 26 |
| UGT94-289-1 H373M | H373M | MIIE | MIIIE | 2.235 | loop 26 |
| UGT94-289-1 H373R | H373R | MIIE | MIIIE | 2.477 | loop 26 |
| UGT94-289-1 H373V | H373V | MIIE | MIIIE | 1.978 | loop 26 |
| UGT94-289-1 H373Y | H373Y | MIIE | MIIIE | 1.805 | loop 26 |
| UGT94-289-1 L374A | L374A | MIIE | MIIIE | 7.024 | loop 26 |
| UGT94-289-1 L374C | L374C | MIIE | MIIIE | 5.443 | loop 26 |
| UGT94-289-1 L374F | L374F | MIIE | MIIIE | 3.296 | loop 26 |
| UGT94-289-1 L374H | L374H | MIIE | MIIIE | 23.005 | loop 26 |
| UGT94-289-1 L374M | L374M | MIIE | MIIIE | 3.215 | loop 26 |
| UGT94-289-1 L374N | L374N | MIIE | MIIIE | 13.766 | loop 26 |
| UGT94-289-1 L374N | L374N | MIII | Siam | 11.674 | loop 26 |
| UGT94-289-1 L374Q | L374Q | MIIE | MIIIE | 3.426 | loop 26 |
| UGT94-289-1 L374Q | L374Q | MIII | Siam | 4.516 | loop 26 |
| UGT94-289-1 L374S | L374S | MIII | Siam | 2.463 | loop 26 |
| UGT94-289-1 L374T | L374T | MIIE | MIIIE | 2.961 | loop 26 |
| UGT94-289-1 L374V | L374V | MIIE | MIIIE | 3.165 | loop 26 |
| UGT94-289-1 L374W | L374W | MIIE | MIIIE | 78.656 | loop 26 |
| UGT94-289-1 L374Y | L374Y | MIIE | MIIIE | 22.105 | loop 26 |
| UGT94-289-1 N47G | N47G | MIIE | MIII | 1.797 | alpha helix 2 |
| UGT94-289-1 H83Q | H83Q | MIIA1 | MIIIA1 | 4.56 | loop 6 |

TABLE 4-continued

UGT94-289-1 Substitution Mutations

| Name | Mutation | Substrate | Product | Fold Increase | Location |
|---|---|---|---|---|---|
| UGT94-289-1 H83Q | H83Q | MIIE | MIII | 1.675 | loop 6 |
| UGT94-289-1 H83W | H83W | MIII | Siam | 2.763 | loop 6 |
| UGT94-289-1 H83W | H83W | MIIA1 | MIIIA1 | 2.302 | loop 6 |
| UGT94-289-1 T84Y | T84Y | MIIE | MIIIE | 2.635 | loop 6 |
| UGT94-289-1 T85G | T85G | MIIE | MIII | 1.476 | loop 6 |
| UGT94-289-1 T85K | T85K | MIIE | MIIIE | 3.118 | loop 6 |
| UGT94-289-1 T85P | T85P | MIIE | MIII | 1.585 | loop 6 |
| UGT94-289-1 T85S | T85S | MIIE | MIII | 1.612 | loop 6 |
| UGT94-289-1 T85Y | T85Y | MIIE | MIIIE | 3.69 | loop 6 |
| UGT94-289-1 N86A | N86A | MIIE | MIII | 1.855 | loop 6 |
| UGT94-289-1 N86C | N86C | MIIE | MIII | 1.583 | loop 6 |
| UGT94-289-1 N86E | N86E | MIIE | MIIIE | 4.633 | loop 6 |
| UGT94-289-1 N86I | N86I | MIIE | MIII | 1.535 | loop 6 |
| UGT94-289-1 N86K | N86K | MIIE | MIII | 1.77 | loop 6 |
| UGT94-289-1 N86L | N86L | MIIE | MIII | 1.59 | loop 6 |
| UGT94-289-1 N86S | N86S | MIIE | MIII | 1.684 | loop 6 |
| UGT94-289-1 N86W | N86W | MIIE | MIII | 1.739 | loop 6 |
| UGT94-289-1 N86Y | N86Y | MIIE | MIII | 1.833 | loop 6 |
| UGT94-289-1 P89M | P89M | MIIE | MIIIE | 2.041 | alpha helix 3 |
| UGT94-289-1 P89S | P89S | MIIE | MIII | 1.603 | alpha helix 3 |
| UGT94-289-1 L92H | L92H | MIIE | MIII | 1.72 | alpha helix 3 |
| UGT94-289-1 L92K | L92K | MIIE | MIII | 1.599 | alpha helix 3 |

TABLE 5

Non-limiting Examples of Structural Motifs in UGT94-289-1 (SEQ ID NO: 109)

| Structural Motif | Borders | Sequence |
|---|---|---|
| Loop 1 | Met1-Thr9 | MDAQRGHTT (SEQ ID NO: 145) |
| Beta Sheet 1 | Thr10-Phe14 | TILMF (SEQ ID NO: 146) |
| Loop 2 | Pro15-Gly18 | PWLG (SEQ ID NO: 147) |
| Alpha Helix 1 | Tyr19-Arg34 | YGHLSAFLELAKSLSR (SEQ ID NO: 148) |
| Loop 3 | Arg35-Phe37 | RNF (SEQ ID NO: 149) |
| Beta Sheet 2 | His38-Phe41 | HIYF (SEQ ID NO: 150) |
| Loop 4 | Cys42-Thr44 | CST (SEQ ID NO: 151) |
| Alpha Helix 2 | Ser45-Ala50 | SVNLDA (SEQ ID NO: 152) |
| Loop 5 | Ile51-Ser61 | IKPKLPSSSSS (SEQ ID NO: 153) |
| Beta Sheet 3 | Asp62-Gln65 | DSIQ (SEQ ID NO: 154) |
| Loop 6 | Leu66-Leu88 | LVELCLPSSPDQLPPHLHTTNAL (SEQ ID NO: 155) |
| Alpha Helix 3 | Pro89-Ala109 | PPHLMPTLHQAFSMAAQHFAA (SEQ ID NO: 156) |
| Loop 7 | Ile110-His117 | ILHTLAPH (SEQ ID NO: 157) |
| Beta Sheet 4 | Leu118-Asp122 | LLIYD (SEQ ID NO: 158) |
| Loop 8 | Ser123-Pro126 | SFQP (SEQ ID NO: 159) |
| Alpha Helix 4 | Trp127-Leu134 | WAPQLASSL (SEQ ID NO: 160) |
| Loop 9 | Asn135-Pro137 | NIP (SEQ ID NO: 161) |
| Beta Sheet 5 | Ala138-Asn143 | AINFN (SEQ ID NO: 162) |
| Loop 10 | Thr144-Gly146 | TTG (SEQ ID NO: 163) |
| Alpha Helix 5 | Ala147-His158 | ASVLTRMLHATH (SEQ ID NO: 164) |
| Loop 11 | Tyr159-Tyr179 | YPSSKFPISEFVLHDYWKAMY (SEQ ID NO: 165) |

TABLE 5-continued

Non-limiting Examples of Structural Motifs in UGT94-289-1 (SEQ ID NO: 109)

| Structural Motif | Borders | Sequence |
| --- | --- | --- |
| Alpha Helix 6 | Ser180-Gly183 | SAAG (SEQ ID NO: 166) |
| Loop 12 | Gly184-Lys189 | GAVTKK (SEQ ID NO: 167) |
| Alpha Helix 7 | Asp190-Ser204 | DHKIGETLANCLHAS (SEQ ID NO: 168) |
| Loop 13 | Cys205-Ser206 | CS (SEQ ID NO: 169) |
| Beta Sheet 6 | Val207-Ile210 | VILI (SEQ ID NO: 170) |
| Loop 14 | Asn211-Glu217 | NSFRELE (SEQ ID NO: 171) |
| Alpha Helix 8 | Glu218-Leu227 | EKYMDYLSVL (SEQ ID NO: 172) |
| Loop 15 | Leu228-Asn229 | LN (SEQ ID NO: 173) |
| Beta Sheet 7 | Lys230-Val232 | KKV (SEQ ID NO: 174) |
| Loop 16 | Val233-Ser252 | VPVGPLVYEPNQDGEDEGYS (SEQ ID NO: 175) |
| Alpha Helix 9 | Ser253-Lys261 | SIKNWLDKK (SEQ ID NO: 176) |
| Loop 17 | Glu262-Ser265 | EPSS (SEQ ID NO: 177) |
| Beta Sheet 8 | Thr266-Ser270 | TVFVS (SEQ ID NO: 178) |
| Loop 18 | Phe271-Ser278 | FGSEYFPS (SEQ ID NO: 179) |
| Alpha Helix 10 | Lys279-Ser292 | KEEMEEIAHGLEAS (SEQ ID NO: 180) |
| Loop 19 | Glu293-His295 | EVH (SEQ ID NO: 181) |
| Beta Sheet 9 | Phe296-Val300 | FIWVV (SEQ ID NO: 182) |
| Alpha Helix 11 | Arg301-Asn307 | RFPQGDN (SEQ ID NO: 183) |
| Loop 20 | Thr308-Gly318 | TSAIEDALPKG (SEQ ID NO: 184) |
| Alpha Helix 12 | Phe319-Val323 | FLERV (SEQ ID NO: 185) |
| Loop 21 | Gly324-Gly327 | GERG (SEQ ID NO: 186) |
| Beta Sheet 10 | Met328-Lys331 | MVVK (SEQ ID NO: 187) |
| Loop 22 | Gly332-Pro335 | GWAP (SEQ ID NO: 188) |
| Alpha Helix 13 | Gln336-Lys341 | QAKILK (SEQ ID NO: 189) |
| Loop 23 | His342-Gly346 | HWSTG (SEQ ID NO: 190) |
| Beta Sheet 11 | Gly347-Ser350 | GFVS (SEQ ID NO: 191) |
| Loop 24 | His351-Gly353 | HCG (SEQ ID NO: 192) |
| Alpha Helix 14 | Trp354-Phe363 | WNSVMESMMF (SEQ ID NO: 193) |
| Loop 25 | Gly364-Pro366 | GVP (SEQ ID NO: 194) |
| Beta Sheet 12 | Ile367-Val370 | IIGV (SEQ ID NO: 195) |
| Loop 26 | Pro371-Leu374 | PMHL (SEQ ID NO: 196) |
| Alpha Helix 15 | Asp375-Ala386 | DQPFNAGLAEEA (SEQ ID NO: 197) |
| Loop 27 | Gly387-Val388 | GV (SEQ ID NO: 198) |
| Beta Sheet 13 | Gly389-Glu391 | GVE (SEQ ID NO: 199) |
| Loop 28 | Ala392-Gln401 | AKRDPDGKIQ (SEQ ID NO: 200) |
| Alpha Helix 16 | Arg402-Val414 | RDEVAKLIKEVVV (SEQ ID NO: 201) |
| Loop 29 | Glu415 | E (SEQ ID NO: 202) |

TABLE 5-continued

Non-limiting Examples of Structural Motifs in UGT94-289-1 (SEQ ID NO: 109)

| Structural Motif | Borders | Sequence |
|---|---|---|
| Alpha Helix 17 | Lys416-Gly436 | KTREDVRKKAREMSEILRSKG (SEQ ID NO: 203) |
| Loop 30 | Glu437-Met440 | EEKM (SEQ ID NO: 204) |
| Alpha Helix 18 | Asp441-Leu451 | DEMVAAISLFL (SEQ ID NO: 205) |
| Loop 31 | Lys452-Ile453 | KI (SEQ ID NO: 206) |

Example 5. Identification and Characterization of Additional UGTs

This Example describes further engineering of a UGT enzyme and identification of additional UGT enzymes.

Figure 6:
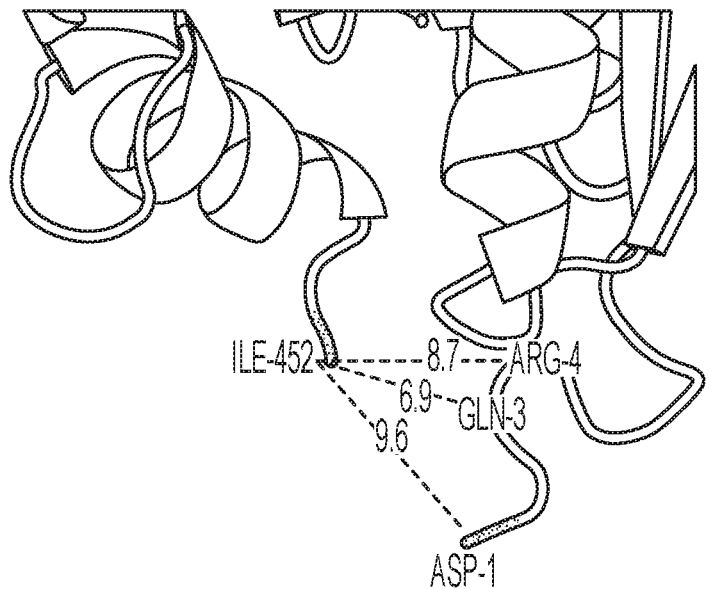
FIG. 6 is a diagram showing the proximity of the N and C termini of the UGT94-289-1 homology model.
Figure 7:
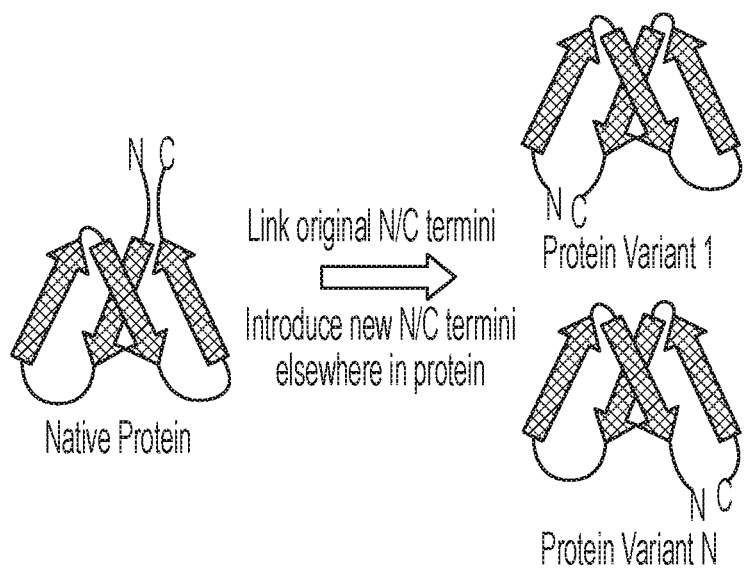
FIG. 7 is a schematic showing circular permutation of a protein. The original N and C termini of the native protein are linked together, either directly or with a linker sequence. New N and C termini are introduced at another position within the protein sequence to produce sequence/structural variants.

Engineering of a UGT involved circular permutation of the protein sequence. The predicted structure of a representative UGT, UGT94-289-1 (FIG. 5) shows that the N and C termini are flexible and in close proximity (7-10 A, FIG. 6). To circularly permute, the original N and C termini were fused together and new termini were introduced at another position within the protein structure (FIG. 7).

Two libraries were screened. One contained circularly permutated versions of a UGT sequence. The other contained additional putative UGT sequences. The S. cerevisiae strain used for the screening comprised: a CDS, two EPHs, a mutant C11-hydroxylase fusion protein, two cytochrome P450 reductases, an upregulated SQE, two primary UGTs, and two transporter knockouts. Two different biological replicates of the same strain were used for screening. The biological replicates are referred to as Background 1 and Background 2. Plasmids encoding the UGTs were transformed into the screening strain. The transformants were inoculated into preculture medium and an aliquot of the inoculated medium was subsequently transferred to production plates.

Following incubation of the production plates, mogroside production was evaluated using a thermo QQQ TSQ-Quantiva ESI with a LX4 multiplexed columns setup. The masses for select ion monitoring (SIM) for the classes of glycosylations with the mogrol backbone (M, MI, MII, MIII, MIV, MV) were as follows: 535.4 g/mol (M), 697.47 g/mol (MI), 799.51 g/mol (MII), 961.56 g/mol (MIII), 1123.61 g/mol (MIV), and 1285.68 g/mol (MV) respectively. MI indicates a product with one glucose moiety, MII indicates a product with two glucose moieties, MIII indicates a product with three glucose moieties, MIV indicates a product with four glucose moieties, and MV indicates a product with five glucose moieties. MI and MII were considered substrates of a secondary UGT, whereas MIII, MIV, and MV were considered products of a secondary UGT. These selective ion monitoring (SIM) intensities were then normalized to an internal standard and calibrated against the following surrogates: MIA1, MIIA1, MIIIA1, Siamenoside, and MV. UGT94-289-1 N143I was used as a positive control. The negative control strain did not express a secondary UGT.

The percentages of MI, MII, MIII, MIV, and MV produced by strains carrying each UGT were compared to the positive control strain. The fraction of MI, MII, MIII, MIV, and MV corresponds to the amount of each type out of the total amount of product produced.

Enzymes were designated as having UGT activity (a hit) based on the following criteria. For the circularly permutated UGT library, enzymes were considered hits if they produced a fraction of MIV (MIV fraction) greater than the mean fraction of MIV (two standard deviations of MIV fraction of each positive control strain). This cutoff was used to identify structural variants that have improved folding and stability, which could have a trade-off with activity. Only constructs that were positive in both biological replicates were considered hits. Table 6 provides data for the MIV and MV fractions.

For the library of putative UGTs, enzymes were considered hits for each product (MIII, MIV, and MV) if they were two standard deviations above the maximum observed value of the negative control strain and greater than the mean of the positive control strain. Table 7 provides data for the MIII, MIV, and MV fractions.

TABLE 6

UGTs Generated by Circular Permutation

| mID | DNA SEQ ID NO | Amino Acid SEQ ID NO | Background 1 MIV fraction | Background 1 MV fraction | Background 2 MIV fraction | Background 2 MV fraction |
|---|---|---|---|---|---|---|
| 69976 (negative control) | | | 0.01 | 0.01 | 0.02 | 0.01 |
| 2043871 | 317 | 323 | 0.28 | 0.16 | 0.03 | 0.02 |
| 2043873 | 209 | 227 | 0.22 | 0.10 | 0.23 | 0.10 |
| 2043875 | 219 | 237 | 0.27 | 0.16 | 0.26 | 0.15 |
| 2043877 | 222 | 240 | 0.27 | 0.15 | 0.26 | 0.16 |
| 2043879 | 329 | 330 | 0.08 | 0.04 | 0.24 | 0.15 |
| 2043881 | 216 | 234 | 0.27 | 0.16 | 0.24 | 0.14 |
| 2044773 | 207 | 225 | 0.29 | 0.17 | 0.28 | 0.18 |
| 2044775 | 210 | 228 | 0.25 | 0.11 | 0.24 | 0.12 |
| 2044777 | 220 | 238 | 0.29 | 0.18 | 0.10 | 0.05 |
| 2044779 | 318 | 324 | 0.27 | 0.16 | 0.08 | 0.04 |
| 2044781 | 213 | 231 | 0.28 | 0.17 | 0.25 | 0.16 |
| 2044783 | 217 | 235 | 0.28 | 0.17 | 0.25 | 0.16 |
| 2045673 | 319 | 325 | 0.32 | 0.15 | 0.04 | 0.02 |
| 2045675 | 211 | 229 | 0.19 | 0.07 | 0.19 | 0.07 |
| 2045677 | 221 | 239 | 0.25 | 0.11 | 0.25 | 0.11 |
| 2045679 | 223 | 241 | 0.26 | 0.13 | 0.23 | 0.11 |
| 2045681 | 214 | 232 | 0.26 | 0.13 | 0.24 | 0.13 |
| 2045683 | 218 | 236 | 0.24 | 0.11 | 0.24 | 0.12 |
| 2046569 | 208 | 226 | 0.27 | 0.15 | 0.28 | 0.15 |
| 2046571 | 212 | 230 | 0.22 | 0.09 | 0.22 | 0.10 |
| 2046573 | 320 | 326 | 0.27 | 0.16 | 0.01 | 0.01 |
| 2046575 | 224 | 242 | 0.19 | 0.11 | 0.24 | 0.14 |
| 2046577 | 215 | 233 | 0.27 | 0.17 | 0.20 | 0.06 |
| 2046579 | 321 | 327 | 0.08 | 0.02 | 0.26 | 0.15 |
| 1385369 (positive control) | 322 | 328 | 0.25 | 0.18 | 0.22 | 0.14 |

TABLE 7

Additional Putative UGTs

| mID | DNA SEQ ID NO | Amino Acid SEQ ID NO | Background 1 MIII fraction | Background 1 MIV fraction | Background 1 MV fraction | Background 2 MIII fraction | Background 2 MIV fraction | Background 2 MV fraction |
|---|---|---|---|---|---|---|---|---|
| Negative Control | | | 0.06 | 0.01 | 0.01 | 0.06 | 0.02 | 0.01 |
| Positive Control | 322 | 328 | 0.24 | 0.25 | 0.18 | 0.26 | 0.19 | 0.12 |
| 2502752 | 243 | 280 | 0.18 | 0.37 | 0.24 | 0.15 | 0.33 | 0.21 |
| 2502758 | 244 | 281 | 0.28 | 0.08 | 0.03 | 0.28 | 0.09 | 0.03 |
| 2502760 | 245 | 282 | 0.33 | 0.23 | 0.08 | 0.24 | 0.26 | 0.16 |
| 2502772 | 246 | 283 | 0.27 | 0.06 | 0.02 | 0.25 | 0.23 | 0.14 |
| 2502784 | 247 | 284 | 0.17 | 0.38 | 0.26 | 0.15 | 0.35 | 0.21 |
| 2502786 | 248 | 285 | 0.17 | 0.36 | 0.25 | 0.06 | 0.02 | 0.01 |
| 2502788 | 249 | 286 | 0.24 | 0.13 | 0.19 | 0.24 | 0.14 | 0.20 |
| 2502806 | 250 | 287 | 0.36 | 0.18 | 0.05 | 0.39 | 0.19 | 0.06 |
| 2502818 | 251 | 288 | 0.25 | 0.20 | 0.09 | 0.24 | 0.19 | 0.09 |
| 2502820 | 252 | 289 | 0.41 | 0.22 | 0.06 | 0.20 | 0.05 | 0.02 |
| 2502830 | 253 | 290 | 0.25 | 0.11 | 0.04 | 0.24 | 0.11 | 0.04 |
| 2502832 | 254 | 291 | 0.22 | 0.16 | 0.06 | 0.28 | 0.08 | 0.02 |
| 2502836 | 255 | 292 | 0.28 | 0.21 | 0.14 | 0.29 | 0.21 | 0.14 |
| 2502840 | 256 | 293 | 0.18 | 0.10 | 0.05 | 0.23 | 0.25 | 0.15 |
| 2502844 | 257 | 294 | 0.29 | 0.19 | 0.12 | 0.25 | 0.17 | 0.10 |
| 2502856 | 258 | 295 | 0.28 | 0.22 | 0.15 | 0.28 | 0.20 | 0.12 |
| 2502866 | 259 | 296 | 0.24 | 0.20 | 0.13 | 0.08 | 0.02 | 0.01 |
| 2502872 | 260 | 297 | 0.38 | 0.07 | 0.02 | 0.28 | 0.26 | 0.13 |
| 2502874 | 261 | 298 | 0.39 | 0.15 | 0.05 | 0.39 | 0.15 | 0.05 |
| 2502876 | 262 | 299 | 0.32 | 0.17 | 0.09 | 0.32 | 0.10 | 0.03 |
| 2502878 | 263 | 300 | 0.32 | 0.16 | 0.08 | 0.32 | 0.10 | 0.03 |
| 2502880 | 264 | 301 | 0.11 | 0.03 | 0.01 | 0.25 | 0.25 | 0.14 |
| 2502882 | 265 | 302 | 0.29 | 0.22 | 0.06 | 0.07 | 0.03 | 0.01 |
| 2502884 | 266 | 303 | 0.06 | 0.01 | 0.01 | 0.35 | 0.12 | 0.03 |
| 2502898 | 267 | 304 | 0.41 | 0.20 | 0.09 | 0.09 | 0.04 | 0.02 |
| 2502912 | 268 | 305 | 0.26 | 0.27 | 0.08 | 0.26 | 0.26 | 0.08 |
| 2502934 | 269 | 306 | 0.33 | 0.06 | 0.01 | 0.12 | 0.03 | 0.01 |
| 2502940 | 270 | 307 | 0.52 | 0.13 | 0.03 | 0.07 | 0.02 | 0.01 |
| 2502950 | 271 | 308 | 0.21 | 0.23 | 0.16 | 0.23 | 0.24 | 0.13 |
| 2502956 | 272 | 309 | 0.23 | 0.24 | 0.12 | 0.23 | 0.22 | 0.11 |
| 2502966 | 273 | 310 | 0.28 | 0.25 | 0.03 | 0.27 | 0.23 | 0.11 |
| 2502976 | 274 | 311 | 0.26 | 0.15 | 0.11 | 0.06 | 0.02 | 0.01 |
| 2503004 | 275 | 312 | 0.29 | 0.15 | 0.09 | 0.27 | 0.13 | 0.08 |
| 2503012 | 276 | 313 | 0.29 | 0.23 | 0.13 | 0.28 | 0.23 | 0.14 |
| 2503040 | 277 | 314 | 0.32 | 0.21 | 0.05 | 0.06 | 0.03 | 0.01 |
| 2503056 | 278 | 315 | 0.15 | 0.22 | 0.09 | 0.16 | 0.22 | 0.09 |
| 2503068 | 279 | 316 | 0.22 | 0.24 | 0.17 | 0.22 | 0.22 | 0.13 |

Example 6: Further Protein Engineering of UGTs

Figure 8:
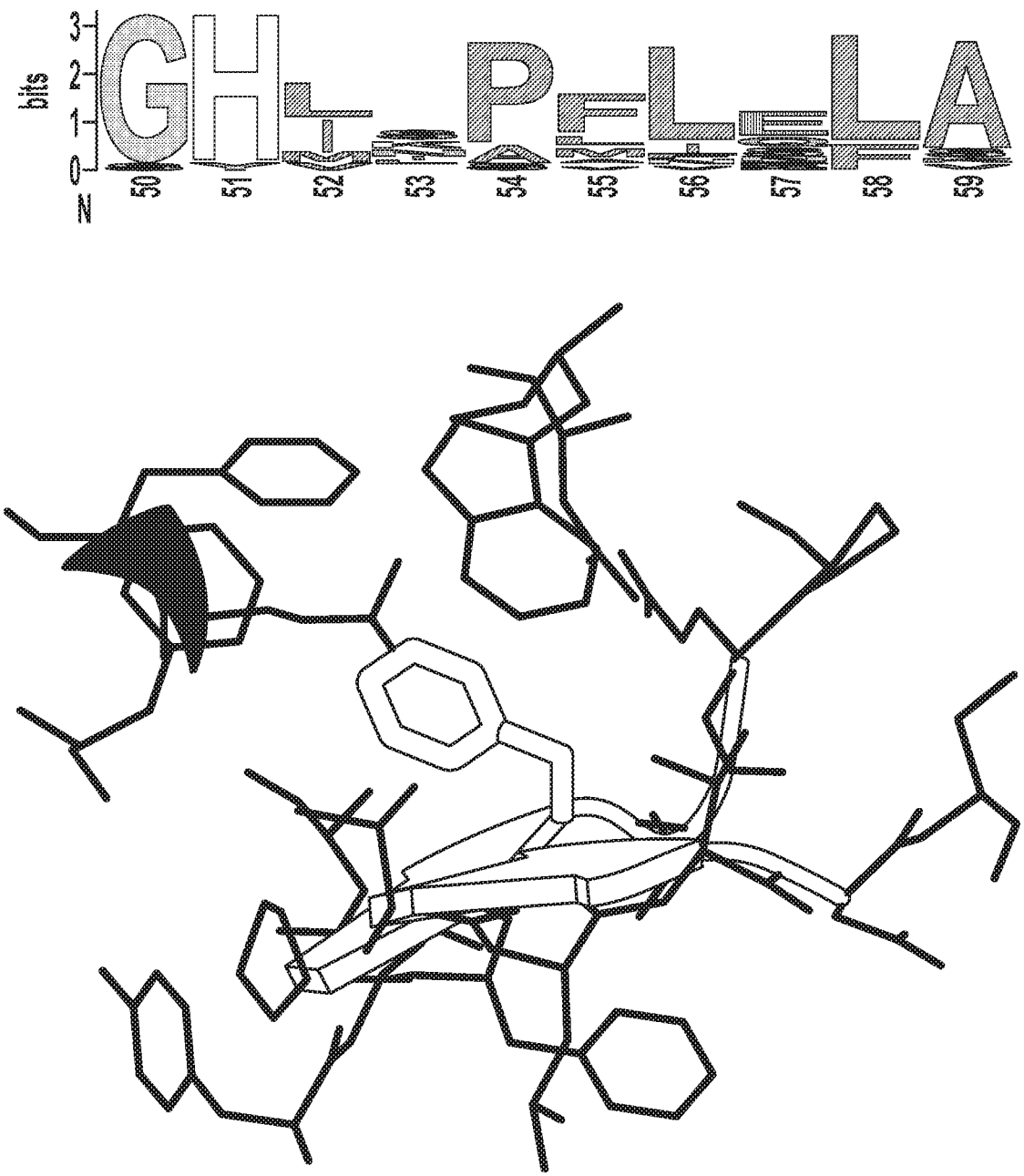
FIG. 8 depicts diagrams showing Position-Specific Scoring Matrix (PSSM) of residues 50-59 of t85024_N143V (top panel) and evaluation of the impact of these potential mutations using the Rosetta energy function (bottom panel). In the bottom panel, the mutated residue is shown as sticks and the surrounding atoms are shown as lines.
Figure 10:
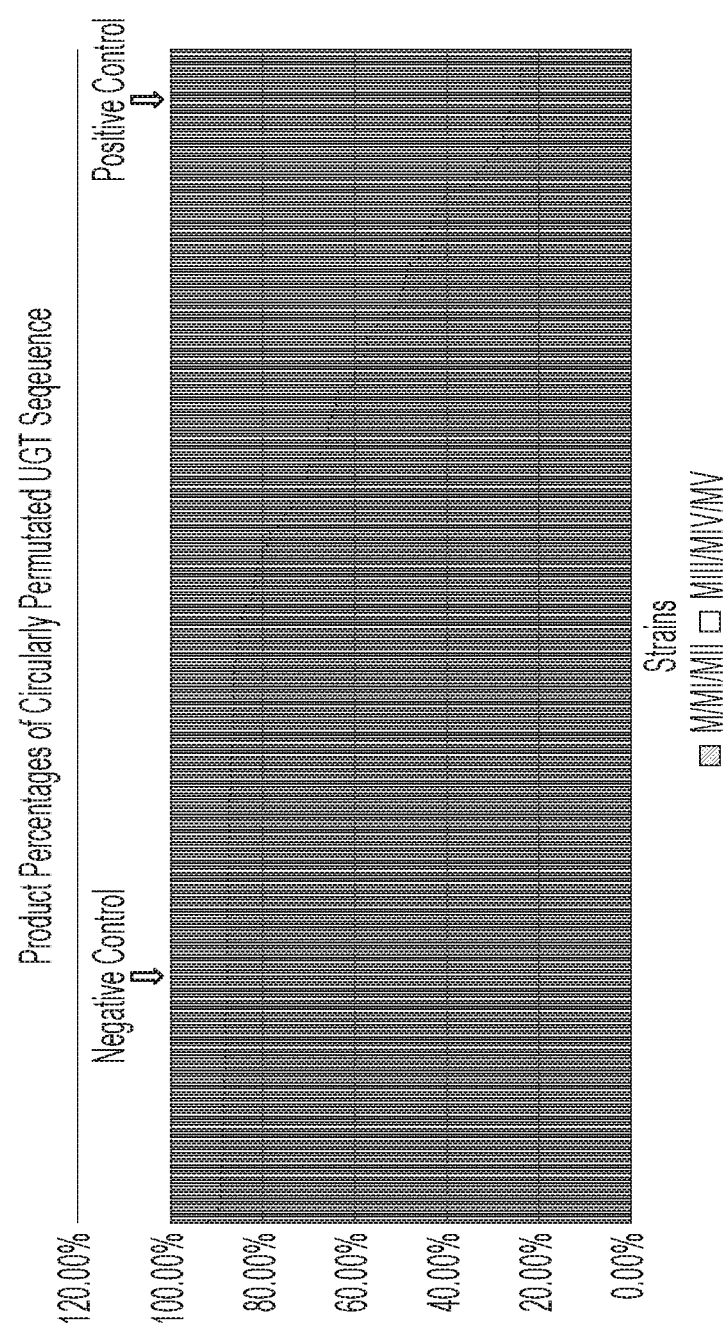
FIG. 10 is a graph showing relative production of M, MI, and MII as compared to MIII, MIV, and MV by UGTs generated by circular permutation.
Figure 11:
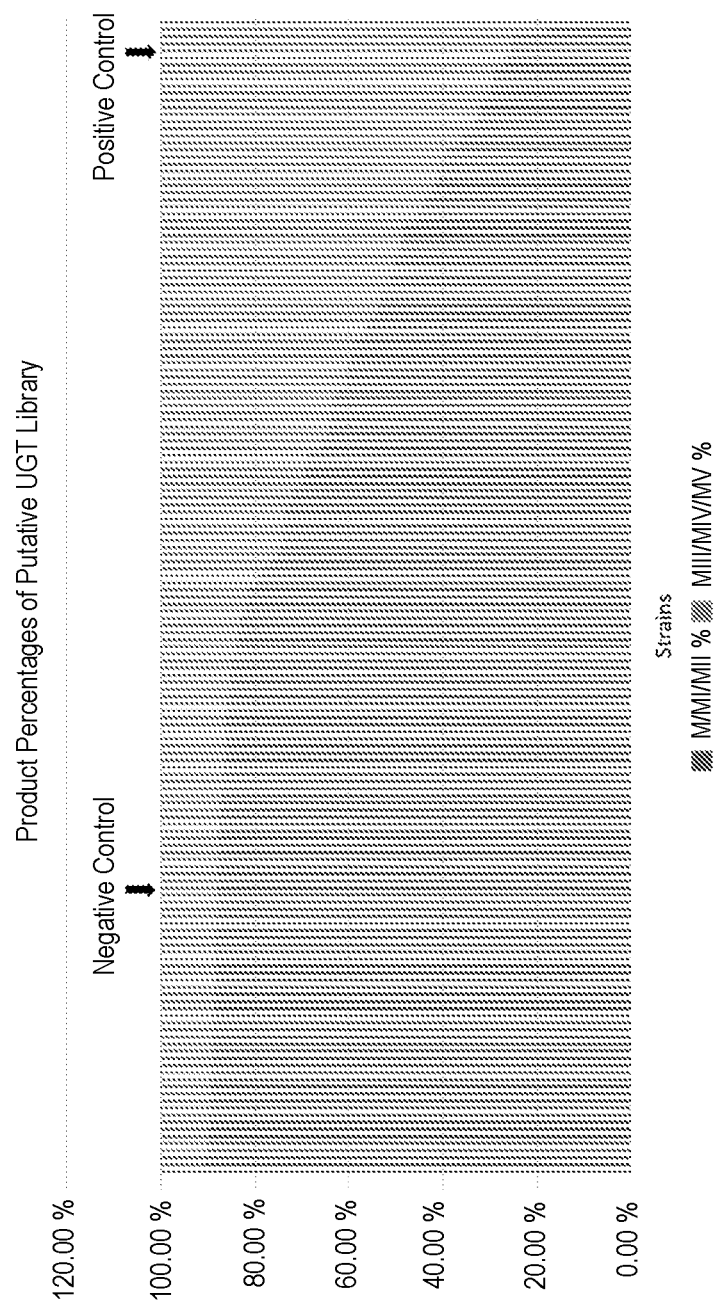
FIG. 11 is a graph showing relative production of M, MI, and MII as compared to MIII, MIV, and MV by putative UGTs.

This Example describes further engineering of a UGT enzyme. A UGT mutation library was constructed based on a position-specific scoring matrix (PSSM) and energy minimization protocol (Goldenzweig et al., *Mol Cell*. 2016 Jul. 21; 63(2):337-346). In this approach, close homologs of a UGT were identified by a BLAST search. These homologs were aligned and a position-specific scoring matrix (PSSM) was calculated from the multiple sequence alignment (FIG. 8). Positions that feature greater sequence variability, such as positions 53 and 57 in FIG. 8, were positions chosen to mutate. The pool of potential amino acid changes was selected from those observed in the PSSM. For example, position 52 was mutated to either L, I, M, or V since these are amino acids observed in the PSSM at that position (FIG. 8). To reduce the mutant pool further, the impact of all potential substitutions on protein stability was evaluated using Rosetta. A pool of mutations used to construct the library comprised those substitutions observed within the PSSM that significantly enhance stability at highly variable positions (Goldenzweig et al., *Mol Cell*. 2016 Jul. 21; 63(2):337-346.). The library will be screened to identify enzymes with UGT activity.

Example 7: Expressing a Combination of Heterologous Enzymes to Produce a Mogrol Precursor, Mogrol, or a Mogroside The recombinant proteins of the present disclosure are used in combination to produce a mogrol precursor, (e.g., 2-3-oxidosqualene, 2,3,22,23-dioxidosqualene, cucurbitadienol, 24,25-expoxycucurbitadienol, 24,25-dihydroxycucurbitadienol), mogrol, or mogrosides (e.g., mogroside I-A1 (MIA1), mogroside I-E (MIE), mogroside II-A1 (MIIA1), mogroside III-A1 (MIIIA1), mogroside II-E (MIIE), mogroside III (MIII), siamenoside I, mogroside IV, mogroside III-E (MIIIE), mogroside V, and mogroside VI).

For example, to produce mogrol, genes encoding enzymes such as a squalene epoxidase, a CDS, an epoxide hydrolase and a cytochrome P450 were expressed in host cells. In some instances, a cytochrome P450 reductase is also expressed in the yeast cells. Non-limiting examples of suitable squalene epoxidases, epoxide hydrolases, C11 hydroxylases and cytochrome P450 reductases are provided in Table 8 below. Non-limiting examples of CDSs are provided in Table 2. Mogrol is quantified using LC-MS. UGTs are further expressed in the host cells to produce mogrosides.

Alternatively, the recombinant proteins are purified from host cells and the mogrol is produced outside of the host cells. The recombinant proteins are added either sequentially or simultaneously to a reaction buffer comprising squalene.

TABLE 8

Non-Limiting Examples of C11 Hydroxylases (P450s), Cytochrome P450 Reductases, Epoxide Hydrolases (EPHs), and Squalene Epoxidases.

| ENZYME | Nucleotide Sequence | Amino Acid Sequence |
|---|---|---|
| C11 hydroxylase | SEQ ID NO: 113 | SEQ ID NO: 129 |
| C11 hydroxylase (cucurbitadienol oxidase) | SEQ ID NO: 114 | SEQ ID NO: 130 |
| Cytochrome P450 Reductase | SEQ ID NO: 115 | SEQ ID NO: 131 |
| Cytochrome P450 Reductase | SEQ ID NO: 116 | SEQ ID NO: 132 |
| Epoxide hydrolase | SEQ ID NO: 117 | SEQ ID NO: 133 |
| Epoxide hydrolase | SEQ ID NO: 118 | SEQ ID NO: 134 |
| Epoxide hydrolase (epoxide hydratase) | SEQ ID NO: 119 | SEQ ID NO: 135 |
| Epoxide hydrolase (epoxide hydratase) | SEQ ID NO: 120 | SEQ ID NO: 136 |
| Epoxide hydrolase (epoxide hydratase) | SEQ ID NO: 121 | SEQ ID NO: 137 |
| Epoxide hydrolase (epoxide hydratase) | SEQ ID NO: 122 | SEQ ID NO: 138 |
| Epoxide hydrolase (epoxide hydratase) | SEQ ID NO: 123 | SEQ ID NO: 139 |
| Epoxide hydrolase (epoxide hydratase) | SEQ ID NO: 124 | SEQ ID NO: 140 |
| Epoxide hydrolase (epoxide hydratase) | SEQ ID NO: 125 | SEQ ID NO: 141 |
| Squalene epoxidase | SEQ ID NO: 126 | SEQ ID NO: 142 |
| Squalene epoxidase | SEQ ID NO: 127 | SEQ ID NO: 143 |
| Squalene epoxidase (P450) | SEQ ID NO: 128 | SEQ ID NO: 144 |

EQUIVALENTS

Those skilled in the art will recognize, or be able to ascertain using no more than routine experimentation, many equivalents to the specific embodiments of the invention described in this application. Such equivalents are intended to be encompassed by the following claims.

All references, including patent documents, disclosed in this application are incorporated by reference in their entirety, particularly for the disclosure referenced in this application.

SEQUENCE LISTING (337 sequences)

SEQ ID NO: 1 - DNA, 2271 bp, Artificial Sequence
  Synthetic Polynucleotide
atgtggagattgaagattgcagaaggtggatccccatggttacgtaccacaaataaccatgttggtagacaaatctgggagttcgaccctaacttgggtactccagaacagataagagaagtcgaagaggctagagaaaacttttggaaaaatagattcgaacaaaagcactcttcagatttattgatgcgtatgcaatttgcccaagaaaactcttccaatgttgtcttgccacaagttaaggtcaaagatgaagacgaaattactaaggaagctgttaaatctaccttggaaagagctttatctttctactccgccgtccagacttcagacggtaactgggcttctgatttgggtggtcctatgtttttattgccaggtttggttatcgctttgtccgtcactggtgccttaaacgctgttttgtctaaggagcaccaaaaggaaatgtgcagatatttatacaaccatcaaaataaggatggtggttggggtttgcacattgagggtcactcaaccatgttcggtaccgttttgacatatgtcactttgagattgttgggtgaaggtgttgatgacggtgatggtgctatggaaagaggtagaaaatggacattagaacatggttccgcaactgctatcacctcttggggtaagatgtggttgtctgttttgggagtcttcgaatgggctggtaataatccaatgccaccagaaacctggttattgccatacatcttaccagtccaccctggtcgtatgtggtgtcattgtagaatggtttacttgcctatgtcatacttgtacggtaaaagatttgttggtccaattactccaacagttttatctttaagaagagaattgttcgacgttccatatcacgagatcgattgggaccgtgccagaaacgaatgtgctaaggaagatttatactatcctcacccattggtccaagacattttgtgggcctccttacataaggccgtcgagcctatattgatgagatggccaggtaaaaagttgcgtgaaaaggctttgtctactgtcatggaacacatacactacgaagacgaaaacaccagatatatttgtttgggtccagttaataaggtcttgaacttgttgtgctgttgggttgaagatccttattctgatgctttcaagttacatttgcaacgtgttcatgactacttgtgggttgccgaagacggtatgaagatgcaaggttacaacggttcccaattgtgggacactgctttttctatccaggctattttagcaaccaacttaggtgaggaatatggtggtacattgagaaaagcacacaatttcatcaaggattcacaaattcaagaagattgtccaggtgacccaaacgtttggtttagacatatccataagggtgcttggccattttccactcgtgatcacggttggttaatttcagactgcactgctgaaggtttgaaagcatccttgatgttatctaaattaccatccacaatggtcggtgaaccattggaagttaacagattgtgtgatgctgttaacgtcttgttgtctttacaaaatgataatggtggtttcgcctcatacgaattgaccagatcttacccatggttggaattgataaaccctgctgagactttcggtgacatcgtcattgactacccatacgttgaatgtacctctgcaactatggaagccttgaccttgttcaagaagttgcatcctggtcacagaaccaaggagatcgataactgcattaaaaaggctgctaaatttttggagaagatgcaaagagctgacggttcctggtatggttgttggggtgtctgttttacttatgcaggatggttcggtataaaaggtttggttgccgctggtagaacttacaattcctgtttggctattcgtaaggcttgcgaatttttgttatctaaggaattaccaggtggtggttggggtgaatcttacttatcctgtcaaaacaaggtctatactaatttggaaggtaataagcctcatttggttaacactgcctgggttttaatggctttgattgaagccggtcaggctaagagagatccaatgccattacacagagctgctaaagttttgatcaactctcaaatgccaaacggtgatttccctcagcaagaaattatgggtgtttttaaccgtaattgtatgatcacctatgctgcttacagaaatattttcccaacctgggctttgggtgaatacagaactcaagtcttacaaaagtaa

SEQ ID NO: 2 - DNA, 2286 bp, Artificial Sequence
  Synthetic Polynucleotide
atgtggcgtttaaaaacaggttctgaaaccgtcggggataacggtagatggttgagatcaactaataaccacgttggtagacaagtttgggagttctttcctgaaatgggttccccagaagaattggtcgctatcgaagccgctcatagagaatttcacttgaatagattccataagcagcactcttccgacttattgatgcgtttgcaatatgagagagaaaagccatgtgttcaaaaggaaggtgcagttagattggacgctactgaaaccccaactgaagccgctgtcgaaaccacattaagacgtgctttaactttctactctaccatgcaatcagatgacggtaactgggcctctgatttgggtggtcctatgtttttgttgccaggtttagttatagctttgtacgtcactggtgtcttgaactccgttttgtccaaagaacatcaaagagaaattagaagatatttatacaatcaccaaaaccaagatggtggttggggtttacacatcgagggtccatctactatgttcggttctgctttgaactacgttaccttgcgtttattgggtgaaggtccagatgacggtgaaggtgcaatggaaagagccagacaatggattttatctcgtggtggtgcagttgctgttacctcctggggtaagttgtggttgtcagtcttgggggtctatgagtgggacggtaacaatcctttgccaccagaattgtggttgttaccatactctttgcctttacatccaggtagaatgtggtgccattgtagaatggtttacttgccaatgtcctatttatacggtaagagattcgttggtcctattactccaactgttttatctttgagagaggaattgtacccaatcccttatcaccatgttgactggaacaaagctagaaacacctgtgctcaggatgatttgtactacccacacccattcgtccaggacttattgtggggttctttatatcacgtctacgaaccattggttatgagatggccaggtaagagattgcgtgaaagagccttgcaacacgtcatgaagcatattcattacgaggatgaaaattctcgttacatctgtttgggtccagttaataaagctttaaacatgttatgctgttgggtcgaagacccacactctgaagcttttaagatgcatataccaagaatttatgactatttgtggatcgccgaagatggtatgagaatgcaaggttataatggttcccaattgtgggatactgctttttccgtccaagctattgtcgccactaagttgacagacgaattttcagagaccttagcaaaggctaacaaatacatcttggatgcccaaattttgaaaaactgtcctggtgatccaaatgtttggttcagacacatccacaagggtgcttggccattctctacaagagaccatggttggttgatctcagattgcactgctgaaggtttgaaggcatccttaatgttgtcaaaattaccttctaagattgttggtgaaccattagagaaaaacagattgtacgacgctgttaacgttttgttgtcattacaaaacgaaaatggtggttttgcttcttatgaattgacaagatcctacccatggttggaattgatcaatccagccgagaccttcggtgatattgttatagattatacctacgttgaatgtacctctgctacaatggaagctttaactttattcaagaagttacacccaggtcatcgtaagaaggaaattgaaagatgtatggctaacgctgccaaattcttggaaatgagacaagaggcagacgggtcttggtacggttgctggggtgtctgttacacatatgctggttggttcggtattaagggtttggttgcagctggtagaacttacaataattgtgcaaacatcagaagagcttgcgactttttgttgtcaaagcagttgccaaatggtggttggggtgagtcctacttgtcctgtcaaaacaaattatacactaacttgaacaatgacagaatgcacaccgtcaacaccgcctgggctatgatggccttgattgaagctggtcaagctaagactgatcctatgccattgcaccatgctgcacgtaccttgattaacgctcaaatggaaactggtgactttcctcaacaagaaataatgggtgtttttaataagaactgtatgatcacttatgctgcctatagaaacgttttcccagtctgggctttaggtgaataccaccaccgtgttttgaacggttgttaa

SEQ ID NO: 3 - DNA, 2286 bp, Artificial Sequence
  Synthetic Polynucleotide
atgtggcgtctgaagacaggctctgagactgttggtgacaacggtagatggttacgcagtaccaataaccatgtcggaaggcaagtatgggaatttttccctgaaatgggttcccccgaagaacttgttgctattgaagccgcacacagagaatttcacctaaaccgtttccataaacagcactcttcagatttgctcatgagattacaatacgagagagaaaagccatgcgtccaaaaagaaggtgctgtgagattggatgctacggagactccaaccgaagcggctgtcgaaactacattgcgtagagccttgaccttctatagcactatgcaatctgacgatggtcactgggctaatgacttgggtggcccaatgtttcttttgccaggtttggttataaccttaactatcactggtacgattaacgttgttttatccaaggaacatcaaagagaaatcagacggtacctatataaccaccagaatcaagatggtggttggggtttgcatatcgaaggaccatcgaccatgttcggtagcgcgttgaactacgttacgttgaggctcctgggggagggtcctgacgacggtgaaggagctatggagagagccagacaatggattctgtccagaggtggtgctgtcgctgtaacctcttggggtaagttatggttgtcagttttgggtgtgtacgaatgggatggtaataacccgttgccaccggagctttggcttctaccttactctttaccattgcacccaggtcgaatgtggtgtcactgtagaatggtctatttgccaatgtcgtacttgtacggtaagagattcgtcggtcctattactccaactgttctttccttaagagaagaactctacccaatcccctatcatcatgtcgattggaacaaagctagaaatacatgtgcacaagacgacttgtattatccacacccatttgttcaagatctgctgtggggttctttgtaccacgtttatgaaccattagttatgagatggcccgggaagagattgcgagaaagagccttacagcacgtgatgaaacatatacactacgaagatgaaaacaccgaatacatttgtttaggaccagtgaataaggcattgaacatgttgtgttgctgggttgaagaccctcattctgaagctttcaagatgcacattccgcggatctatgattacctgtggatcgctgaagacggcatgaaaatgcaaggttacaacggcagtcaattgtgggatactgccttcgccgtccaagctatcgttgctacaaagttgactgacgaattttccgaaaccttggccaaagctaataagtacattttggacgctcaaatactgaagaactgtccaggtgatcctaatgtatggtacagacatattactaagggggcttggtctttttctaccgcggatcaaggttggcttgtttcagactgtaccgctgaaggtttgaaggcattattgttgtactctatgctcccacaccagaaagccccatccagcatcgaaaagaaccgtctttatgatgctgtaaacgttttactatctatgcaaaacgctgatggtggtttcgcttccttcgaacttacgcgtagttatccatggttggaaatgattaacccagccgaaacattcggtgacatagtcatcgattacacttacgtcgaatgtacctctgctgtgattcaagcattggctttgttcaagagattgcacccgggacacagaaagaaggaaatagagaggtgtatggctaacgcagctaaatttttggagatgagacaagaagccgatggctcatggtatggttgctggggtgtttgttatacatacgccggttggtttggtatcaaaggtctaacctcctgtggtagaacttacaataattgcgccaacattagaagagcttgcgactttttattgtcgaaacaactgccaaatggtggttggggcgagtcctacttgagctgtcaaaacaagttgtacaccaatttgaacaacgaccgtatgcacactgtcaatactgcttgggctatgatggcgttaattgaagctggtcaagccaagactgacccaatgcccctacatcatgctgctagaaccctaattaatgcacagatggagaccggcgactttccccaacaagaaatcatgggtgttttcaataagaattgtatgatctcttacgccggttatagaaacgttttcccagtatgggctttaggcgaataccatcacagagtgttgaacggttgttaa

SEQ ID NO: 4 - DNA, 2226 bp, Artificial Sequence
  Synthetic Polynucleotide
atgtggcgtttgaagatcgcagagggtaaagaaggtccttacttaaagtcaacaaacaattttgttggaagacagacctgggaatttgacccagatgccggtactccagaagaaagagctgctgtcgaagaagccagacgtgctttctattctaacagatacagagttaaaccaccagctgatttgttatggagattgcaattcatgagagagaagaatttcaagcaaattattcctatggtcagaatcaaggacggtgaagctataactcacgaaaaagcaaccgccactttgagaagagccgttcatttcttgactgtcttacaatccatcgacggtcactggccagctgagaacgctggttgccattactttttgccaccattagttttttgtttgtatattacaggtcacttgtcttccgttttctctcaagaacatcaaagagaaattttgcgttacatctataatcaccaaaacgaagatggtggttggggtttacacatcgaaggtcactctattatgttctccaccgctttgtcttacatatgtttgcgtattttgggtgaaggtttagaaggtggtcaggacaacgcttgtgctaaggctcaaaaatggattttagatcatggttcagttactcacataccttcctggggtaagacctggttgtctgtcttgggtttgttcgattggtccggttcaaatccaatcccaccagaattttggatgttaccatcttttttacctattcatccaggtaagatttggtcatactgccgtactacatatatgccaatgtcctacttgtatggaaagaagttcgtcgctcctatcaccccattgattatccaattaagaaaagagttgtacttgcaaccatacgacgaaataaactggagaaaggttagacatttgtgtgcaaaggaagatttgtattacccacacccagttattcaagatttaatgtgggactgtttatacgtcttcactgaacctttgttgaatcgttggccattgaacaagatgatcagagaaaaagccttgaaggttaccatgaaccatattcactacgaagatgagaactcttcttatatcaatatggcttgtgtcggtaaagttttgtgtaccttggcttgctgggttgaagacccaaacggtgactacttcaaaaagcacttggccagaatcccagattacatttgggtcgctgaagatggtatgactatgcaaggtttggcctctcaaacttgggactccggtttagctatccaagcattgtttgcctccaacttgatagatgaaattggtccaactttaaagagagctcatgatttcatcaagaagtctcaagttttagacaatccttttggtgactttaaaaagatgttcagacactcctctaagggttcatggaccttctcagtcagagatcacggttggcctgtttctgactgtacagctgaaggtttgaaatgctgtttgttgttgtctatgttaccacaagagattgttggtgaaaagttagaagttgagagattgcatgatgctgtcaatatcattttccacttacaatccaagaacggtggtgtcgccgcatgggaacctgttagagcatccaaatggttggaattgttgaatccaatcgaatttttggaagatatagttgtcgaccatgagtatttagaatgtaccgcttcttctatagacgctttacagttatttaagaaattataccctacttgtgagcgtgaagaaattgaaaacttcatcttgaaggctgttgaatatatcgaaaacattcagatgtctgatggttcttggtatggtaactggggtgtctgcttcatctacggtacattgttcgctttgaagggtttagctaaggcaggtaagacttatgacgattgtgtcgctatgagaaaaggagttgattttttgttaagaatccaaagagacgatggtggttggggagagtcatacaagtcctgtccaaataaaaagtttgaaccattgcagagagaaggttccaacgtcgtccaaactgcttgggccattttaggtttgattgagtctcgtcaaattatgagagacccaaccccattgcacagagcaataaagttcatcatcaactctcaattagaagatggtgactttccacaacaggttagaggtttgtcctacatttattcatctttgtcctttttgccagttattaagatgtaa

SEQ ID NO: 5 - DNA, 2301 bp, Artificial Sequence
  Synthetic Polynucleotide
atgtggcgtttaaagatcggtgccgacaccgtcttgacagatccatcaaatgcaggaggtagatggttgtctactttatccaaccatttgggtagacaggtttgggaattttgtgctgagttgggttctcctgaagacttgcaacaaatacaacacgctagacaaagattctccgatcacagattcgaaaaaaagcattctactgacttattgatgcgtatgcaatttgctaaggaaaactcatctttcgttaatttgccacaaattaaagtcaaggataaggaggatgttaccgaagaagccgtcactagaactttgaaaagagctattaacttctattctaccatccaggcacacgacggtaactgggcttccgacttaggtggtccaatgtttttgttgcctggtttagttattgctttgtacgttacaggtgttttgaactccgtcttgtctaccgaacatcaaagagaaatctgccgttacttatataatcaccaaaacagagatggtggatggggtttgcatatcgagggtccatctactatgtttggttccgtcttgaactacgttactttaagattattgggtgaagaagccgaagacggtcaaggtggtgtcgataaggctagaaagtggattttagatcacggtggtgctaccgccataacatcatggggtaagatgtggttgtctgttttaggtgtttacgaatgggcaggtaataatccattgccaccagaattgtggttgttaccatacttgttgccttgtcatccaggtagaatgtggtgtcactgtagaatggtctatttgccaatgtgttacttgtatggtaagcgtttcgttggtcctattacaccaattatcagatccttgagaaaagagttgtacttagttccttatcacgaagttgactggaacgtcgctagaaaccaatgcgctaaagaagatttgtactatccacatccattagtccaggatgtcttatgggcctctttgcatcacgtttacgaaccattgttcatgtgttggcctgctaagagattgagagagaaggcattaagaactgttatgcaacacatacactacgaagatgaaaattctcgttacatctgtttgggtccagtcaacaaagtcttgaacatgttgtgctgttgggttgaagacccacattccgaggctttcaagttgcatattcctcgtttgtatgactacttatggattgctgaagacggtatgagaatgcagggttacaatggatcacaattatgggatactgccttttctgtccaagctatcatgtctaccaaattgtcagaagaatacggtaccactttgagaaaggcccacaagtatattcaagattcacaagttcaagaagattgcccaggtgatccaaatgtttggtttagacatatacacaaaggtgcttggccattctccactagagaccatggttggttgatctctgactgtacagctgagggtttgaaggcctctttgatgttatctaagttgccttccaagatcgttggtgaaccattagaaaaggaaagattgtatgacgctgttaacgttttgttgtcattgcaaaacgaaaacggtggtttcgcctcctacgagttgaccagatcttatccatggttggaattaattaacccagctgaaaccttcggtgatattgttatagactacccatacgttgaatgtacttccgctgcaatccaggctttggctgcctttaagaaattgtacccaggtcacagatctaatgaaattggtaactctatagctaaagccgctgacttcattgaatcaatccaagcaacagatggttcttggtacggttcttggggtgtctgtttcacctacgctggttggtttggtattaagggtttagtcgctgctggtagaacttacaattcctgctcctctttgagaaaggcttgtgatttcttaatgtccaaggaattggcagccggtggttggggtgagtcctacttgtcctgtcaagataaggtttataccaacatcaaagatgatagaccacatttggtcaacactggttgggctatgttgtcattaatcgacgctggtcaagctgaaagagatcctacaccattgcaccgtgctgccagaatattgattaattcccaaatggaagacggtgactttccacaggaagagatcatgggtgttttcaacaagaattgtatgattacttatgcagcttatagaaacatctttccaatttgggcattaggtgaataccgttgcagagtcttacaagcctcttaa

SEQ ID NO: 6 - DNA, 2292 bp, Artificial Sequence
  Synthetic Polynucleotide
atgtggaggctcaaagttggggcagaaagtgtaggagagaaggaagaaaaatggctaaagtccatatctaaccacttgggccgacaagtgtgggaattttgtgcgcatcagcctaccgcttcgccgaatcatcttcaacagattgacaatgcccgcaaccatttccgtaataatagatttcacagaaaacaatcatctgatttattcttagctatccaaaacgagaaggaaattgcaaatgtcacaaaaggtggtggtattaaagttaaggaggaagaggatgtcagaaaagaaacggtaaagaacactgttgaaagggccttgagcttttactcagctatacaaactaatgacggaaattgggcaagtgatctaggcggtccaatgttcctgttgccaggactggtaatcgctctatatgttacaggtgttttaaattccgtgttgagcaagcatcacagacaggagatgtgccggtatttatacaaccatcaaaacgaagatgggggatggggtctgcatatcgaagggacttcgaccatgtttggttctgcccttaattatgtggccttgagattattaggcgaggatgcggacggtggcgaaggcggtgctatgacaaaagcacgtagctggattctggatcgtggtggggcaacggctataacttcttggggaaaattgtggctttcagtgttaggagtctatgaatggtccggtaacaaccctttgcccccagaattttggctcttaccctactgtcttcctttccacccaggccggatgtggtgtcattgcagaatggtatatctaccgatgtcgtacttatatggtaaaaggtttgttggaccaatcacgcctatagtcttgagtttaaggaaggaactttatacaattccctaccatgaaatcgattggaatagatctcgaaatacttgcgctaaagaagacttgtactatccacatccgaagatgcaagatattttgtggggctcaatttatcacctgtatgaacctcttttcaccagatggcctggcaaacgcttaagggagaaagcactccaaatggctatgaagcacatacactacgaggatgaaaactctcgatatatatgtctcggtccagttaacaaagtcttaaatatgctatgttgttgggtggaggacccatacagtgacgcattcaaatttcatttgcaaagagttcctgattacctatgggtagcggaagatggaatgagaatgcagggttataatggctcccagctgtgggatacagcgttttctgtacaagccattatttcaactaaacttatagattcttttggtaccacattaaaaaaggcccatgatttcgttaaagactctcaaatccaacaagactgccctggggatccaaacgtctggttcagacatattcataagggggcttggcccttttccacccgggatcacggttggctaatttcagattgtacggctgaaggtttgaaggctagcttaatgctaagtaagttgcctagtaagattgtcggagaacccctcgaaaaatcgcgtttatgcgacgccgttaatgttctgttatcgttgcagaatgagaacggcggttttgcaagctacgaactcacgaggtcctatccatggctcgaactaatcaatccagctgagacatttggagatatagtgatagactatccgtatgtcgaatgtacctcagcaactatggaagcattgaccctcttcaaaaaacttcatccgggtcatagaactaaagaaattgacatcgcagttgctagagcggccaatttccttgaaaatatgcaaagaaccgacggttcatggtatgggtgctggggcgtatgttttacttacgctggatggttcggtataaaaggtttagtcgcagcgggtagaacatataatagttgtgtagctattcggaaagcctgtgattttttactttctaaggaattgcccggagggggttggggcgagtcctacttatcctgccagaacaaagtttatactaaccttgaaggcaatcgtcctcatctggttaacactgcatgggtgctgatggccttgatagaagctggccaggctgagcgtgatccagcaccattgcatcgtgcagcgaggttgttgattaattcgcaactagagaatggtgatttcccacaagaagaaataatgggagtgtttaacaagaactgtatgattacatacgctgcttaccgcaatattttcccgatctgggcactaggagagtattttcacagggtattaacagag

SEQ ID NO: 7 - DNA, 2292 bp, Artificial Sequence
  Synthetic Polynucleotide
atgtggaggctcaaagttggggcagaaagtgtaggagagaaggaagaaaaatggctaaagtccatatctaaccacttgggccgacaagtgtgggaattttgtgcggaccagcctaccgcttcgccgaatcatcttcaacagattgataatgcccgcaaacatttccgtaacaatagatttcacagaaagcaatcatctgatttattcttagctatccaaaatgagaaagaaattgcaaacggtacaaaaggtggtggaattaaggtcaaagaggaagaggacgttagaaaggaaacggtgaaaaacactgttgaaagggccttgagcttttactcagctatacaaactaatgatggcaattgggcaagtgatctaggtggaccaatgttcctgttgccaggtctggtcatcgctctatatgtaacaggcgttttaaattccgtattgagcaagcatcatagacaggagatgtgccggtatttatacaatcaccaaaacgaagacgggggttggggactgcatatcgaagggacttcgaccatgtttggttctgcccttaattatgtggccttgagattattaggcgaggatgcggatggtggcgaaggtggtgctatgacaaaggcacgtgggtggattctggaccgtggaggggcaacggctataacttcttggggtaaattgtggctttcggtattaggagtttatgaatggtcaggcaacaaccctttgcccccagaattttggctcttaccctactgtcttcctttccacccaggtcggatgtggtgtcattgcagaatggtgtatctaccgatgtcatacttatatggtaaaaggtttgttggaccaatcacgcctatagtcttgtccttaaggaaggaactttatacaattccctaccatgaaatcgattggaacaaatctcgcaatacgtgtgctaaagaggatctatattatccacaccccaaaatgcaagatattttgtggggcagtatttaccatttatatgaacctctgttcactagatggccaggaaaacgcctgagagaaaaggcattgcagatggctatgaagcatatacactacgaagacgagaatagtagatacatttgcttgggtcctgtgaataaagttctgaacatgttgtgttgttgggtagaggatccgtacagtgacgcgtttaaattccatttacaaagagttccagactacctatggatagcagaagatgggatgagaatgcaaggttataatggctcgcagctatgggacacagctttttcagtccaagcaattatctctactaagctgattgattcttttggcaccactttgaaaaaggcacatgatttcgttaaagattctcagattcaacaggattttccaggtgacccgaatgtctggttccgacacatccacaagggtgcctggcccttttcaacccgagatcatggctggttgatatccgattgtacagccgaagggttaaaggcgagccttatgttaagcaagttaccttcgaaaattgtaggtgaaccattagaaaaaagtagactatgcgatgcagttaacgttcttttatcactacaaaatgaaaacgggggctttgctagctacgagttaaccaggtcatatccatggttggaattaataaaccctgccgaaacgttcggagacattgtgattgattatccatacgtagagtgtacctccgcaactatggaggctcttactctttttaagaaattacacccaggtcatcgtacaaaagagattgatacagcggtcgccaaggctgctaatttcctcgaaaatatgcaaagaaccgatggaagttggtacggatgctggggtgtctgttttacttatgccggttggtttgggattaagggtttggttgccgcagggcgcacatattccacttgcgtcgccatcagaaaagcttgtgatttcttgttgtcaaaagaattaccaggcggtggatggggtgaatcttatctatcttgtcaaaacaaagtctatactaatctcgaaggtaataggcctcatttggtgaatacagcttgggttctgatggccctcatcgaggctggtcaagcggaaagagatcccgcaccactacatcgtgctgcaaggctcttgatcaattcacaattagagaacggtgattttccgcaggaagaaatcatgggtgtattcaacaagaactgcatgataacctacgccgcttataggaatatttttcctatatgggctcttggagagtactttcatagagtgctaactgag

SEQ ID NO: 8 - DNA, 2295 bp, Artificial Sequence
  Synthetic Polynucleotide
atgtggcgtttgaaggttggtgccgagtctgtcggcgaaaaagatgaaaagtgggttaaatccgtctcaaaccacttaggtagacaagtttgggaattttgcgcagacgctgccgctgatacccctcatcagttgttgcaaatccaaaatgctagaaaccacttccatcacaatagattccatagaaagcaatcttccgacttatttttggctattcaatacgaaaaggagattgctaagggtgccaaaggtggtgctgttaaggtcaaagaaggtgaagaagttggtaaggaagccgtcaagtctactttagagcgtgctttgggtttctattctgctgttcagacatcagacggtaactgggcttctgatttaggtggtccaatgtttttgttgccaggtttggttatcgcattacacgtcactggtgttttgaactccgtcttgtccaagcaccatagagttgaaatgtgtagatacttgtacaaccatcaaaatgaagatggtggttggggtttgcacatagaaggtacctctactatgttcggttctgctttgaattatgttgccttgagattgttaggtgaagacgcagacggtggtgatggtggcgctatgaccaaggctagagcatggatattagagagaggtggtgctacagctatcacttcatggggtaagttgtggttgtccgtcttaggtgtttacgaatggtccggtaacaacccattaccaccagaattttggttattgccttattctttgccattccatcctggtagaatgtggtgtcactgtagaatggtctacttaccaatgtcttatttgtacggtaagcgtttcgttggtccaattactccaaaagtcttgtctttgagacaagagttgtacaccattccatatcacgaaatcgattggaataaatcccgtaacacctgcgctaaggaagacttatactatcctcacccaaagatgcaagacattttgtggggttctatctaccatgtctacgaacctttgttcactagatggccaggtaaaagattgcgtgagaaggccttacaagcagctatgaaacatattcactatgaagatgaaaactcaagatacatctgtttgggtccagttaataaggttttaaacatgttatgttgttgggtcgaagacccatactccgatgccttcaagttgcacttgcagagagtccacgattacttgtgggttgctgaagacggtatgagaatgcaaggttacaatggttcccaattatgggataccgccttttctattcaagctatagtcgcaactaagttagttgattcttacgcacctactttgcgtaaggctcatgacttcgtcaaagactcacaaatccaagaagattgtcctggtgacccaaatgtttggtttagacacattcataagggtgcctggccattttccacaagagaccacggttggttgatttcagattgtacagctgaaggcttaaaggcttctttgatgttgtctaagttaccttccactatggttggtgagccattggaaaagaacagattgtgtgatgctgtcaacgttttattgtctttgcagaacgacaacggtggtttcgcttcttatgaattaaccagatcctacccatggttggaattgataaatccagctgaaactttcggtgacattgttatcgattacccatatgttgaatgcactgccgccaccatggaagctttgactttattcaaaaagttgcaccctggtcacagaacaaaggaaatcgataccgcaatcggtaaagctgctaacttcttagagaaaatgcaaagagccgatggttcttggtacggttgttggggtgtttgttttacttacgctggttggttcggtattaagggtttggttgcagctggtcgtacctataattcttgcttggctattagaaaggcctgtgaatttttgttgtccaaggaattgccaggtggtggttggggtgaatcttacttgtcctgtcaaaacaaagtctacaccaacttggagggtaacaagccacatttagtcaacaccgcttgggttttaatggctttgatcgaagctggtcaaggtgaaagagatccagctcctttgcatagagcagcccgtttgttaatgaactcccaattggaaaatggtgattttgttcaacaggaaataatgggcgttttcaataaaaactgtatgattacatatgctgcctatagaaatatcttcccaatttgggctttgggtgaatattgccacagagtcttaactgaataa

SEQ ID NO: 9 - DNA, 2322 bp, Artificial Sequence
  Synthetic Polynucleotide
atgtggaggctcaaagttgggaaggaaagtgtaggagagaaggaagaaaaatggataaaatccatctctaaccacttgggccgacaagtgtgggaattttgtagcggtgagaatgaaaatgacgatgatgaggcaattgcggttgccaacaattcagcttctaagttcgaaaatgctcgtaaccattttcgcaataatagattccatagaaaacagtcgtccgacctatttttagcaattcaatgcgaaaaggaaatcattagaaacggtgccaaaaacgagggtacaaccaaggtcaaagaaggagaagatgtaaaaaaggaagcagtgaagaatacgctggaaagggctctttcgttttattcagcggttcaaacttcagatggcaattgggccagtgacctaggtggacctatgttcttattgccaggtttagttatagccttgtacgtcactggcgtacttaactcagttttgtctaaacaccatagacaggagatgtgtaggtatatttacaaccatcaaaatgaggatgggggttggggtttgcacatcgaaggttctagtacaatgtttggctctgctctcaattatgtcgctttaagacttttgggtgaggcagcagatggtggggaacatggggctatgactaaagcacgaagctggattttagaaagaggaggtgctaccgcgataacttcgtggggaaaactgtggctttccgtgttaggcgtttatgaatggtctggaaataatcccctaccaccggaattttggcttttaccttactccttgccattccatccgggtcggatgtggtgccactgtcgtatggtctacttgcctatgagctatctgtatgggaagcgcttcgttggaccaataacacctatcgtgctctcactcagaaaggaattatacacgattccctatcatgagattgattggaaccggagtcgaaatacctgcgccaaagaagatttatattatccacatccaaaaatgcaggacattttatgggggagtatctaccatgtatacgaacctctgttttctggttggcccggcaaacgtctaagggagaaggccatgaaaatcgctatggaacacatacactatgaagatgagaatagcagatacatttgtttgggacccgttaataaggtactgaacatgctatgttgctgggttgaagacccttattcagatgctttcaagtttcacctacaaagaatcccagactacctctggttggcagaagatggtatgaggatgcaaggatacaatggttcacaattgtgggatacagctttttcaatacaagctattatctcaacaaaattaattgacacatttggcccaactcttcgtaaagcgcatcatttcgtaaaacactctcagatacaagaagactgtcccggcgatccgaacgtttggtttagacatatccataaaggagcctggccattttccactagagatcatggttggctgatttcggactgcaccgcagaaggcctaaaagccagtcttatgctctctaagttgccttctaagatagtcggtgagcctttggaaaagaatagattatgtgacgccgtcaatgtgctgttgtctttacagaacgagaatggtggcttcgcaagctatgaattgactagaagctatccatggctggagctgattaaccctgctgaaacattcggcgatattgtcattgattatagttacgtagaatgtacctctgcgactatggaggcattagctttattcaaaaagttacatccaggacaccggacgaaagaaattgacgcagccatcgcgaaagccgctaatttcctagaaaacatgcaaaaaacagatggttcatggtatggttgttggggtgtgtgttttacctatgctggctggtttggtataaaaggtttagttgccgcaggtcgcacctataataattgcgttgctatacgtaaggcttgcaactttctattatccaaggaattgccgggtggcggatggggagaatcttatttgagttgtcaaaacaaagtttacactaacttagagggtaacaaaccgcaccttgtaaatacggcttgggtcatgatggcattaatcgaggcagggcagggtgaaagggacccagcccctttacatagagctgcaagattgttaattaacagtcaattagaaagtggtgatttcccacagcaggagattatgggcgtgtttaataaaaactgtatgatcacatacgccgcttacagaaacatatttcctatatgggcattaggggagtattcacatcgtgttcttgatatg

SEQ ID NO: 10 - DNA, 2172 bp, Artificial Sequence
  Synthetic Polynucleotide
atgtggcgtttaaagttgggtaaaggagagaacgaagattacttgttttctaccaatgacttcatcggtagacaaacttgggaatttgatcctaacgctggtacaccacaggaaagagcccaagttgaagctgcaagattaaatttctatcaaaacagaaaccacgtccaatgttcatccgacttgttgtggagattccaatttttggaagagaagaacttcaaacaagctataccaaaggtcgttgttgaagaacgtaatggtaacgatagagaattatctattaagaaggagaccgttaagactgccttgagacgtgctactaacttctttgctgcattacaatccaatcatggtcactggccagctgaaaatgccggtccattgtactatttgcctccattggtcttcgctttgtacattactagagacttgaacaccatcttgtctaaagaacatcaaaaagaaattttaagatacgtttattgccaccaaaatgaggatggtggttggggtttgcacatcgcttctcgtcagtcatgtatgttatgtactgtcttgaactacattgaattaagattattgggtgaagaagctgataacgaagcatgctccagagccagaaagtggatattggaccatggtggtgctttgtacatcccatcttggggtaagatttggttgtctatcttgggtttatatgaatgggaaggtaccaaccctatgccaccagagatttggatgttcggtaagatattgccatggaacttgggtggtttgttatgttacacaagattaaccttattgccaatgtcctacttgtatggtaagagatttgttggtcctttgaccccattaatcttacagttgcgtcatgaaatttacactcaaccatataatgacatcaaatggtcaccagctagacacttgtgtgccaaggaagatgaatacttcgaaagatctattttccagaagttagtttgggacgtcgttacatacgtcggtgaaccaatcttgaagtcctgggcttttaagaaaattagaaatcgtgctatacaaatcgccaagtggtacatggactatgaggatcaaaactcacattacatcactattggttgtgttgaaaagcctttgtttactttgacatcttgggttgtcgatcctcacggtgaagcatataaaaagcatttagctagaataaaggactacttgtgggtcggtgaggacggtatgaagatgcaatcattcggttcccaatcttgggatgttgcatttgctattcaagctattttggctaccaacttacaccacgaattttctgaaactttaaaaaaaggtcacgacttcatcaaacaatctcaagttaagaagaatccatccggtgatttcccaagaatgtacagacatatctccaaaggttcttggaccttttcagatcaggatcacggttggggtgtctccgactgtgctgctgaaaacttgttgtgctgtttgaagttgtctactatgccttcccatattgttggtgattctatggaaccacaatgtttctttgaagccgttaatttcatattgtcattacaagccaaagacggtggtttgtctgcctgggaaccagctggaacattgcctttgtggtttgaagttttgaatcctgttgaatttttcgagtacactgttttggaaattgagtgtgtcgaatgtacttcctctgccattcaagctttggtcttgtttaagaagttgttcccatcccacagaaaaaaagaaattgataacttcatcgaaaaggccaccaattatattaaggaaatccaaaaggaggacggttcttggtatggtaactggggtatttgtcacatctacggtacttacttcgctataaaaggtttagctgctgctggaaatacttacgaaaattgctccaccgtcactaaggctgtcgatttcttgttgaagatccagtgtccagacggtggttggggtgaatctcatatctcttgcttgaacaaagtccatactccattaccaggtaacgcatctaacttggttcaaacctcattcgctttgatgtctttaatccactcccaacaagtctgtttttttttattcttcttcttcccatcatttttaccaatttgcactttgccttccttgataattatcttctaa

SEQ ID NO: 11 - DNA, 2298 bp, Artificial Sequence
  Synthetic Polynucleotide
atgtggcgtttaaaggtcggtgctgacacagttccagccgatccttctaaatcaggcggttggttgtccactttgtctaatcatttgggtagacaggtttgggaattttgtgcagagttgggttccccagaagatttacaacaaatacaacacgctagacaacacttctctgaccatagattcgaaaagaagcactctgctgacttattgatgagaatgcaatttgccaaagaaaactcatcattcgtcaacttgccacaaatcaaggttaaggataaggaagatgtcatggaggaagctgttaccagaactttgaaacgtgctattaatttttactccaccatccaggccgatgacggtaactgggcatctgacttgggtggtcctatgttcttgttaccaggtttggtcattgctttgtatgttactggtgttttgaactctgttttgtccaccgaacatcaaagagaaatttgcagatacttatacaatcaccaaaacagagatggtggttggggtttacacatcgaaggtccatccaccatgttcggttctgttttaaattatgtcactttgagattattgggtgaggaagctgaagacggtgaaggtggtgttgacaaggccagaaaatggatcttagatcatggtggtgctacagctataacttcatggggtaagatgtggttgtccgtcttgggtgtctatgaatggaccggtaacaatccattaccacctgaattgtggttgttgccatacttgttaccagttcacccaggtagaatgtggtgtcattgtcgtatggtttacttaccaatgtgttacttgtatggtaagcgttttgtcggccctattaccccaattattagatctttgagaaaggaattgtacttggttccataccacgaggtcgattggaacgaagctagaaacttatgcgccaaagaggatttatattaccctcatcctttggtccaagacatcttgtgggcttctttacaccacgtttacgaaccattgttcatgagatggccagctaagcgtttgagagaaaaggcattaagaactgttatgcaacatattcactatgaagacgaaaattcccgttacatctgtttgggtccagtcaacaaagttttaaacatgttgtgttgttgggttgaggatcctcattctgaagccttcaagttgcacatcccaagagtctatgattacttgtggattgcagaggacggtatgagaatgcaaggttacaacggttctcagttatgggatactgctttctccgttcaagctataatttccacaaagttggctgaagaatacggtaccactttaagaaaggcccacgaatacatcaaagactctcaagtcttggaagactgtccaggtgaccctaacgtttggtttagacacatacacaagggtgcttggccattttcaactcgtgatcatggttggttgatttctgattgcaccgctgaaggtttgaaggcatcattgatgttgtctaaattgccatctaaaattgtcggtgaaccattagaaaaagaaagaatctatgattcagttaatgtcttattgtctttacagaatgagaacggtggtttcgcttcctatgagttgacaagatcctacccatggttggaattaattaacccagctgaaacttttggtgacatcgttatagactacccttacgttgaatgtacttccgccgctatccaagctttggccgcttttaagaagttatacccaggtcaccgttctaacgaaattggtaactgtatcgccaaggctgccgatttcattgaatccatccaagctaccgatggttcttggtatggctcttggggtgtttgtttcacatacgcaggttggttcggtattaagggtttggttgccgctggtagaacctacaacaattgcttgtcattgagaaaagcttgtgattttttgttatctaaagaattagccggtggtggttggggtgaatcctatttgtcctgccaagataaggtctacactaacattaaagatgacagacctcatattgtcaataccggttgggctatgttgtctttaatagaggttggtcaagctgaaagagacccaacaccattgcacagagccgcacgtatattgattaactcacaaatggacgacggtgattttcctcaagaagagatcatgggtgttttcaacaagaattgtatgatcacttacgcagcttacagaaacattttcccaatttgggctttaggtgaatacagatgtagagtcttgcaagctccataa

SEQ ID NO: 12 - DNA, 2358 bp, Artificial Sequence
  Synthetic Polynucleotide
atgtggcgacttaaggtcggcaaagagtccgtgggagaaaaggaagaaaagtggataaaatcaatcagtaaccacctgggtcgtcaggtttgggaattttgtgccgagaatgacgatgacgatgacgatgaagcagttattcatgtcgtagctaacagctctaagcacctattacaacaacaaagaagacaatcttctttcgaaaacgctaggaagcaattcagaaataatagatttcatagaaaacaaagttccgatctcttcttgaccatccagtacgaaaaggaaattgctcgcaacggtgcgaagaacggtggtaatactaaggttaaagaaggtgaagacgtcaaaaaggaagctgttaacaatacgttggagagagccttgagcttctattcggctattcaaactggtgatggtaactgggcaagtgatttgggcggtccaatgttcttgttacctgggttggttatcgctttatacgtcacaggtgtgttgaactccgttctatctaagcaccatagacaagaaatgtgcagatatatctacaaccaccaaaatgaagacggtggatggggtttgcatattgaaggttcatctaccatgtttggtagtgcccttaactacgtagctttgcgtttattgggtgaagacgctaacggaggtgagtgtggtgcaatgactaaggctagatcctggatactggaaaggggtggggccacagctattacttcttggggtaagctctggttgtccgttctaggtgtctacgaatggtctggcaataatcccttaccaccggaattttggttgttaccatattctttgccattccacccaggtagaatgtggtgtcactgccggatggtctacttgcctatgagttatctatacgggaaaagatttgttggtccaattaccccaatggtgttgagcctaagaaaggagctttacaccattccctatcatgaagttgactggaacagatctcgtaacacttgtgcccaagaggatttgtactacccacacccaaagatgcaggacatcttatggggttccatttatcatgtttacgaaccgctattcaacggttggcctggtagaagattgagggaaaaagctatgaagatagcgatggaacacatccactatgaagatgagaactctcgttacatctgtttgggtccagtcaacaaagtcttgaacatgctgtgttgttgggtcgaagatccatactctgacgctttcaagtttcacctgcaacgaatccccgattatttgtggttagctgaagatggcatgagaatgcaaggttacaatggttcacaattgtgggacacggccttttccattcaagctatattatccactaaattgattgacaccttcggttccaccttgagaaaggctcatcattttgtgaagcattctcaaattcaagaagattgtccaggcgatccaaacgtttggttcagacacatccataagggtgcttggccgttctcaactagagaccacggttggctaatttcagactgtacagccgaaggacttaaggcgtctttaatgttgtctaaattgccttctaaaatcgttggtgaaccattggaaaagaatagattgtgcgacgctgttaatgtattgctttccttgcagaacgagaatggtgggttcgcttcttacgaattgactagatcctatccatggttagaactcattaaccccgcagaaaccttcggtgacatcgttattgattacagctatgtcgaatgtacgtcagccactatggaagctttggccctctttaagaaactccatccaggtcacagaacaaaggaaatcgacgctgctcttgccaaggcggctaacttcttagagaatatgcaaaggacggatggttcttggtacggttgctggggtgtgtgttttacctacgcaggttggttcggcatcaaggggctagtggctgctggtaggacttacaacaactgtgttgccatcagaaaggcttgtcatttcttgctaagtaaagagttgccaggtggtggttggggagaatcctacctcagttgccaaaataaggtttatactaacttagaaggaaacagaccacacctagtcaataccgcctgggtattgatggcattgatcgaagctggtcagggtgagagagatcctgctccactgcatcgcgccgctagattgttgattaactcgcaattagaaaacggtgattttccacaacaagaaattatgggtgttttcaacaaaaactgtatgattacttacgctgcttatcgaaatatatttccgatttgggccttaggtgaatactcgcaccgtgttttgactgaataa

SEQ ID NO: 13 - DNA, 2295 bp, Artificial Sequence
  Synthetic Polynucleotide
atgtggcgtttaaaagtcggagccgagtcagttggcgaaaaggatgaaaagtgggtaaagtccgtgtctaatcacttgggtcggcaggtttgggaattttgtgctgacgcagacgctgtcaccccacatcaaagtctacaaatccacaacgctaggaaccatttccaccaaaatagattccgtagaaaacaatcctctgatctgtttttggcgattcaatacgaaaaggaaatagccaagggtgttaaagttggtgctgtcaaggttaaggagggtgaagaagttggtaaggaagctgtaaaatctactcttgaaagagcattatcgttctatagcgctgtccaaacgtcggatggtaactgggcctctgacttgggtggtcctatgttcctcttgccagggttggtcattgctttgtacgtcactggtgttttaaactccgttctatctaagcatcacagattggaaatgtgcagatatctttacaaccaccagaatgaagacggaggttgggggttgcatatcgagggtacatccaccatgtttggatcagctttaaattacgtggcattgagattgcttggtgaagatgctgacggtggtgatggtggtgccatgactaaggctagagcctggattttggaacgaggcggtgctaccgctattacttcttggggcaaattatggctgagtgttttgggtgtgtatgaatggtctggtaacaatcccctaccaccggaattttggttgctcccatactctctaccattccatcctggtagaatgtggtgtcactgtagaatggtttacttaccaatgtcctacttgtatggaaaaagattcgtcgggccaatcacccctaaggtcttgtccctaagacaagagttgtacaccgtaccataccatgaaatcgattggaacaaatctaggaacacatgtgcaaaggaggatttgtactatccacacccaaagatgcaagacatattatggggttcaatttatcatgtgtacgaacccttgtttactagatggcctggtaaaagattacgtgaaaaggctttgcaaactgcgatgaagcacatccactatgaagatgaaaacagcagatacatatgtttgggtccagttaataaggttctgaatatgttatgctgttgggttgaagacccatacagtgatgctttcaagttacacttgcaacgcgtccacgactatttgtgggtcgctgaagatggtatgagaatgcaaggttataacggttcgcaattgtgggacacagccttcagtattcaggcaatcgtcgctactaaacttgtcgattcatacggccccactctacgcaaggctcatgactttgttaaagattcacaaatccaagaagactgtccaggtgacccgaacgtttggtttcgacatattcacaagggtgcttggccattctctacaagagatcatggttggttaatttccgactgtactgccgaaggtttgaaagcgtctttgatgttgagtaagttaccatcaaccatggttggagaacctttggaaaagtctcgactatgcgatgcggtaaacgttctgttgtcccttcaaaatgataacggtggttttgcttcttacgaattgaccagatcgtacccatggcttgagctaattaatccagctgagacattcggtgatatcgtaatcgactacccatatgttgaatgtaccgcagccactatggaggctcttacgttattcaagaaattacatccgggccacagaactaaggaaattgacaccgctatcgctaaagccgctaattttttggaaaagatgcaaagaactgatggttcttggtatggttgttggggtgtttgtttcacttacgctggttggttcggaatcaagggtctcgtcgctgctggtcgtacatataactcctgcgtagccattagaaaagcttgcgaatttttgttatctaaggaacttccaggtggtggctggggcgagtcttacttgtcctgtcaaaacaaggtctacaccaatctcgaagggaacaagcctcacttggtcaacactgcatgggttttaatggccttgattgaagctggtcagggggagagagatccggctcccttacacagagccgccagattgttgatgaactcgcaattagaaaatggagacttcctccaacaagaaatcatgggggttttcaataaaaactgtatgataacgtacgccgcttacagaaacatattcccaatttgggcgttgggtgaatactgtcaccgcgtcttgacggaataa

SEQ ID NO: 14 - DNA, 2298 bp, Artificial Sequence
  Synthetic Polynucleotide
atgtggcaattaaaggttggtgccgatacagtcccttccgacccatctaacgctgggcgttggttgtctaccttgaataaccatgttggtagacaggtctggcactttcacccagagttaggttcaccagaagatttgcaacaaatccaaaatgcaagacaacatttctacgaccacagattcgaaaaaaagcattcctctgacatattgatgagaatgcaatttgctaaagaaaactcttcattcgttaacttacctcaaattaaggttaaggaaaaggaagatgtcgttgaagaggctgttactcagactttgcgtagagccatgaatttctattccaccatccaggctgatgatggtcactggccaggtgactacggtggtccaatgtttttgttgccaggtttggtcattactttatctattactggtgctttgaacgccgttttatcaaccgaacatcaaagagaaatctgccgttatttgtacaatcaccaaaacagagatggtggttggggtttgcacattgaaggtccatccacaatgttcggttctgtcttgtcctacgttaccttgagattattgggtgaagaagctgaggacggtcaaggtggggtcgaaaacgcaagaaaatggatattggatcatggtggtgctacagctattacttcttggggtaagatgtggttatcagtcttgggtgtttatgagtgggctggtaataaccctttgccacctgaattgtggttattaccatacttattgccatttcacccaggtagaatgtggtgtcattgtagaatggtctacttaccaatgtgttatttgtacggtaagagattcgttggtcctatcactccaatcatcagatctttgagaaaagaattgtacttggtcccataccacgaaattgactggaacgaagccagaaatcaatgcgctaaggaggacttgtactatcctcatccattggttcaagacgttttgtgggcttccttgcaccacgtttacgaaccattattcatgagatggccagctaaacgtttacgtgaaaaggccttaagaaccgtcatgcaacacattcattacgaagatgaaaacaccagatatatctgtattggtcctgttaataaggttttgaacatgttgtgttgttgggttgaagacccacactctgaggcttttaagttacatataccacgtatttatgattacttatggttggcagaagatggtatgaagatgcaagggtacaatggttctcaattgtgggacactgccttcgcagtccaggctattatgtccacaaagttggttgaagaatatggtactactttgagaaaggcccacaaatacattaaagattcacaagtcttggaagattgtccaggtgacttgcaatcttggtacagacatatatccaagggtgcttggccattttctaccgctgatcatggttggcctatctccgattgtactgccgaaggtttgaaggctgttgtcttgttgtctaagttaccttccgagattgtcggtaaaccagttgacgaagagagaatgtacgacgccgttaacgttatcttatctttacagaacacagacggtggttttgctacctatgaattaaccagatcctatagatggttggaattgatgaacccagctgaaaccttcggtgatatagttatcgattacccatatgtcgaatgcacttccgcagcaattcaagctttagctgctttccgtaagttgtatccaggtcacagatctaatgagatcggtaactgcattgctaaagccgcagatttcatagaatctattcaagctactgacggttcttggtacggttcttggggtgtttgttttacctatggtggttggtttggtatcaaaggtttggttgccgctggtcgtagatacgaaaattcttcttcattgagaaaggcttgtgattacttattgtccaaggaattgccagccggtggttggggtgagtcatacttgtcatgtcaagacaaagtctacaccaatattaaggatgatagaccacacttagttaacaccgcttgggctatgttatcattgatcgacgcaggtcaagctgaaagagacccaactccattgcatagagccgccagaattttaatcaactcccagatggaagatggggatttccctcaagaagacatcatgggtgtctttaataaaaattgcatgatatcttattctgcttacagaaacatcttccctatttgggcattgggtgcttatcgttgtcgtgttttgttggcttcttaa

SEQ ID NO: 15 - DNA, 2298 bp, Artificial Sequence
  Synthetic Polynucleotide
atgggtgaaatgtggaaattgaagttttctaagggttgggagacctcagaaaacgatcacgttgggcgtcaatattgggaatttgacactaatttaactccttccgaagaagaaaaggcacagatacaaaaattctacaacgaattttacaactatagattccaagccaagcattcttccgatttgttaatgagattccaattgagaaaggagaataacggtggtgaagtcaaattgccaacacaaatcaagattaccggtgaagaagagattaacgaagaagctatcgaaaagaccttaagacgtggtattagattctactctacattgcaaactcaagacggtttttggccaggtgactacggtggtccattgttcttgttgccagctttagttattggtttgtctgtcactaaggctttggatactgctatatcagttcaccatagacacgaaatgtgtagatacttatataatcatcagaacgaagacggtggttggggtttgcacatcgaaggtaattccactatgttgtgcaccgcattgtcttatgtctctttaagattattgggtgagaagatggatggtcgtgatggtgttttgttaaaagccagaagatggattttagacagaggtggtgctacatccatcccttcctgggggaagacttggttgtctgtcttgggtgtttacgaatgggaaggtaacaatccattgccaccagagatctggttgttaccatactcattacctttgcacccaggtagaatgtggtgtcactcaagaatggtttatttgccaatgtcttacttgtatggtaaacgtttcgtcggtcctatttctccaataatcatttctttgagaagagaattgtacacctgttcctaccatacaatcgactggaacttatctcgtaacttatgtgctaaagaagatttgtacaccccacattctaagattcaaaatatattgtggaactccatccacaagtttggtgagccattgttaaagaaatggccattgtccaaggttagacaaaaagccttggatttcgtcattcaacatatccattacgaagacgaaaacacccactacttgtgtttaggtcctatttctaaggttttaaatatggtttgctgttgggctgaagatcctaactcagaagcattcagaagacatatcccacgtattaaagattatttgtggttggctgaagacggtatgaagatgcagggttataacggttctcagttgtgggacgtcgtctttgctgttcaagccatcttagctactgatttagttgacgagtacggttctgttttgaagaaggcccacaacttcataaagaactctcaaatgaagagaaatgggattaaagaccaaaacaacccatccgtttggtatagacacatgtctaaaggtggttggccattctcaactcctgataacgcttggccagtctccgactgcacagctgaagctttgaaggcagctatcttgttgtcacaaatgcctactaccatggttggtgaaccaattgatgtccacaatttgtacgatgctgtcaacttgattttgtcattgcaaaactccaatggtggttttgcatcctacgaattgaccagatcctatccatggttggaaatgttaaacccagccgaaatatttggtgatgttatgatagactaccaatacgttgaatgtacttctgctgccattcaaggtttgaaagctttcatgaagttacacccaggttatcgtaagaaagacattcaaacttgtatctctaaggctgctcacttcattgaaactatccagttgccagatggttcctggtacggttcctggggtatctgctacacttacggtacctggtttggtattaagggtttggttgcctgtggtagaacctacgctaactctaaatgtatccgtaaggccacacaatttttgttgtctaaacaattgaagtcaggtggttggggtgaatcatacttgtctgctcatcacaaggtctatgcagatttaaaagacggtaagtctcacattgtcaatacctcttgggcattattagctttgattcaagccgaccaagctcaaagagatccatctcctttgcatagagctgccactgttttaattaattcacaaatggatgatggtgacttcccacaacaagaaatcatgggtgtttttaataagtcttgtatgatttcctatgctgcatacagaaatatcttcccaatctgggctttaggtgaatacagaatcagagttttacaattgcctgagaactaa

SEQ ID NO: 16 - DNA, 2301 bp, Artificial Sequence
  Synthetic Polynucleotide
atgtggagattaaagattggtgccgacactgtaccatccgatcccagcaacgctgggggttggctgtcgaccctatcaaatcatcttggaaggcaggtgtgggagttttgcgctgaattgggttctccggaagatttgcaacaaatccaacaagcacgtcaaagattctctgaccacagattcgaaaaaaagcactccgctgacctcttgatgcggatgcaatttgccaaggaaaactctagtttcgtcaacttgcctcaggttaaagttaaggataaggaagaagtctctgaagaagctgtcacaagaactttgcgaagagcaattaatttctattccacgatacaagctgatgacggcaactgggcctcggatttaggtggtccaatgtttttgttaccaggtttggttatcgctctctacgttaccggcgttttaaattccgtgcttagtactgagcatcaaagagagatttgtagatacttgtacaaccaccaaaaccgtgatggtggttggggattgcacatcgaaggtccatctaccatgttcggttctgtgttgaactatgtcactcttagactactgggtgaagaagccgaagacggtcaaggtgctgttgacaaggctagaaaatggatattggatcatggtggggccgcggcgattacatcatggggtaagatgtggctatccgttctgggtgtctatgagtgggctggcaataatccattgcctccagaattgtggttattaccttacctcttgccatgtcacccaggtagaatgtggtgtcactgtagaatggtttacttgccaatgtgctacttgtatgggaaacgttttgtcggtccaatcaccccaattatccggtctttgagaaaggaactctacttggttccctaccatgaagttgattggaataaggcaagaaaccagtgtgctaaggaagatttatattacccacatcctctagtacaagacatcttgtgggcttctttacatcacgtctatgaacctttgttcatgcactggccagctaaaagacttagagaaaaggctttacaatcggttatgcaacacattcattacgaagatgaaaacagcaggtatatatgtctgggtccagtaaacaaagttttaaatatgttgtgctgttgggccgaagacccacattccgaagctttcaagttgcacattccgagaatttacgactacctatggatcgctgaggacggtatgagaatgcagggttacaacggttctcaattatgggacactgcgtttagcgtccaagctattatcagtacagaattggccgaagagtatgaaactacccttagaaaggcccataagtacataaaagattcacaagtcctagaggattgtccaggagatccaaacgtttggttcaggcacattcacaagggtgcatggcctttctctacaagagaccacggttggttaatttccgactgtaccgctgaaggtttgaaggcttctctcatgttatccaaattgccttcgaagatcgtaggagaaccactagaaaagcaacaactgtacaatgctgttaacgtgttgttatccttgcagaacgagaacggtggcttcgcatcttacgaactaactcgttcttacccatggttagaactaattaatcccgctgaaacgtttggtgacatcgtgattgattatccgtacgtcgaatgctcctctgctgcaatccaagctttggccgcctttaaaaaattgtacccagggcatagaagagacgaaatcaacaattgtattgccaaggctgctgatttcatcgaatctattcaggctactgatggtagttggtatggttcctggggtgtctgtttcacgtacgccggatggtttggtattaagggtctagtcgcggccggtcgcacttacaacaactgctcttcattacggaaggcttgtgatttcttgctaagtaaggagttggctgctggtggttggggtgaaagctatctctcttgtcaaaataaggtttacaccaacattaaggatgaccgcccacacatagttaatactggttgggctatgttgtcacttatagacgcagggcaatccgagagagatccaacccctttgcacagagctgcaagagttttgataaattcccaaatggaagatggtgattttccacaagaagaaatcatgggtgtttttaacaaaaactgtatgatcacatatgctgcctacagaaacattttcccaatatgggctttgggggaatacagatccagagttttaaaattattaaagtaa

SEQ ID NO: 17 - DNA, 2289 bp, Artificial Sequence
  Synthetic Polynucleotide
atgtggcgtttgaagatcgctgacggtggcaacgatccttatatttactccacaaatgattttataggtagacagacttgggaatttgacccagaggccggtaccccagaagaaagacaagaagttgaagaagcaagacaccatttctacagaaaccgttataaagtcaagccatctgctgattgtttatggagaatgcaattcttgagagaaaagaaattcaagcaagagatcggtgctgtcaaaattaaggaaggtgaagaaatttctcaagacaaggccagaatcgctttacgtagagccgttcacttctactcagctttgcaagcttctgatggtcattggccagcagaaaatgctggtccattgttttttttacctccattggttatgtgcttgtacataactggtcacttagaccaagttttccctgaagaacataagaaagaaattttgagatacatctattgtcaccagaacgaggatggtggttggggtttgcatattgagggtcattccaccatgttctgtactgccttgtcctacatttgtatgagaatcttgggtgaaggtccagacggtggtttaaacaatgcttgtgctagaggtagaaagtggattttagatcacggttctgtcacctacatcccatcttggggtaagacctggttgtccattttgggtgtttacgactgggctggctcaaacccaatgccacctgaattttggttattgccatctttcttgccaatgcacccagccaagatgtggtgctattgtcgtatggtctatatgcctatgtcctacttgtatggtaaaagatttgtttgtcaaatcactcctttaattcaagaattgagattggagttacatgctcaaccattcgatgaaataaactggaagaaaactagacacttatgtacaaaagaagatgtttattacccacacccattgatgcaagatttgttgtgggactcattatacatttgtactgaacctttgttaaccagatggccattcaataagttggtcagagagaaggctttgcaagttacaatgaaacacatccattatgaagacgataactctcgttacatcaccatcggttgcgtcgaaaaggttttgtgcatgttagcatgttgggtcgaagatccagatggtgactacttcaagaaacacttggcacgtattcctgactacatttgggttgccgaggacggtatgaaaatgcagtcctttggttctcaagaatgggacactggtttcgctatccaagctttattggcagctgatatggctgacgaaataggtccagttttggctagaggtcatgattttattaagaagtctcaggtcaaggataatccatctggtaacttcaagaccatgcacagacatatatcaaaaggttcttggactttctccgaccaagatcacggttggcaagtctccgactgtaccgccgaagccttgaagtgctgtttgttgttctcattaatgagaccagaaattgtcggtgacaagatggaagctcaaagattgtatgactctgttaacgttttgttgtctttgcaatctaaaaatggtggtttggcagcttgggagcctgctactggtcaaaagtggttggaaatgttaaacccaacagaattttttgctgacattgttatcgaacacgagtacgtcgagtgtaccgcctcagctatccaagctttgatcttgttcaagaagttacatccaggccatagaactaaggaaattgataactttattcaaaatgctgtcagatacttgcaggatatccaaatgccagatggttcttggtacggtaactggggtgtttgtttcacctatggttgctggtttgccttaggtggtttagttgccgcagctaagacattcaataactgtgccgctataagaaaaggtgttcatttcttgttgaacattcaaatgccagatggtggttggggtgaatcctaccactgttgcccatctaagaagtatgtcccattggaaggtaagcgttcaaatttggttcacactgcctgggctatgatggccttgatccactctggtcaagctgaaagagatcctactccattgcatcgtgctgcaaagttattaattaattcccagacagaagatggtgatttccctcaacaagaaattaccggtgtttttatgaaaaactgtatgttgcactatgctgcatacagaaacatctacccattgtgggctttagctgaatactctaaaagagttaagttggcttcaacttctccataa

SEQ ID NO: 18 - DNA, 2289 bp, Artificial Sequence
  Synthetic Polynucleotide
atgtggcgtttaaaagtcgcagacggtggcaacgatccatacatctattccatgaataactttgttggtagacaaatatgggaatttgaccctgatgctggttctccagacgagagagctgaagttgaaagagtcagaaatgaatttacaaagaaccgtttgaagggtttcccatcagccgatttgttatggagattgcagttgttaagagaaaaaaatttcaagcaatctattccacctgttaaggtcgaagacggtgaggaaattacctacgaaatggcctccgatgctatgaagagaggtgcttatttcttggaagcaatccaagcttctgatggtcactggccttccgagacttctggtccattgttctacttgtgtccattattgatttgcatgtacatcatgggtttcatggattcagctttttctccagaacataagaaagaaatgatgagatatttatacaaccaccaaaacgaagacggtggttggggtttgcatgttggtggtcactcaaacatgttctgtactaccttcaactacatttccttgagattgttaggtgaggaaccagatgttgaagccgtcgctaaaggtcgtatctggatcagagaccatggtggtgttacttctattttgtcctggggtaagacctggttgtctatattgaatttgttcgactggtctgcctctaatccaatgccacctgaatattggatgtttccaacatgggtccctattcacccatccaatatgatgtgttacactagaatcacctacatgccaatgtcatatttatatggtaagagatttcaagctccattgactccattagttttacaattgcgtgatgaattgcacactcaagcttacgaaaagattaactggagaaaggttagacacatgtgtgcaaccgaggacttgtacttcccacatccattcgttcaggacttattatgggatactttgtatatgttgtctgaacctttaatgacccgttggccatttaataaattgatcagacaaaaagctttggatgaaacaatgagacatattcattacgaggatgaaaactctcgttacataacaattggctgcgtcgaaaagccattgtgtatgttagcctgttgggtcgaagacccaaactctgaatatgttaaaaagcacttcgcaagaatacctgattacttgtggatggctgaagacggtatgaagatgcaatcctttggttcacaatcctgggatgccgctttggctatgcaggctttgttggcctgcaatatcactcacgatattggttcagctttgaacaacggtcacgaatttattaagaactctcaagttagaaataaccctccaggtgactacaagtccatgttcagatatatgtccaagggttcctggaccttctctgactgtgatcatggttggcaagtttcagactgtactgctgaaaatttaaaatgttgtttgttgttatccttgttgccacctgagatcgtcggtgaaaagatggagccacaaagattctacgatgctgttaacgtcatcttgaacatgcaatctaagaacggtggtttacctgcctgggaaccagcatcttcttactactggatggaatggttgaacccagtcgaatttttagaagatttgatcattgaacaccaacatgttgaatgtacctcttcagctttgcaggctattttattgttcagaaaacaataccctgagcacagaaagaaggaaatcaataacttcattaacaaggcagtccaatttttgcaggacatacaattgccagatggttcctggtatggtaactggggtatctgctacacctacggtacttggttcgctttgaaagctttgtcaatggcaggtaagacatatgagaactgtgaagctttgcgtaaaggtgccaattttttaattaagatccaaaacccagaaggtggtttcggtgaatcctatttatcttgtccatataaaagatacattccattagacggtaaaagatctaacttggttcaaactgcttggggtatgatgggcttaatcgccgctggtcaagctgatgttgatccaggtccaatacacagagcagccaagttattaatcaactcccaaactgaagatggtgacttccctcaagaagagattactggtgaattttttaagaactgcacattgcatttcgctgctttcagagaagtcttccctgtcatggctttgggtgaatactgtaataaggttccattgccatctaaaaaaaataccatcaattaa

SEQ ID NO: 19 - DNA, 2280 bp, Artificial Sequence
  Synthetic Polynucleotide
atgtggcgtttaaaggttgcagatggtggcaatgacccttatatctactccatgtctaaccacttgggtagacaggtctgggaattttgtgctgacgctggttcaccagatgagagagccgaagttgaaagagtcagaaacgaatttactaaaaacagattgaagggtttcccatctgctgatttattgtggagattgcaattgttacgtgaaaaaaatttcaagcaatccattccaccagttaaggtcgaagacggtgaggaaataacatacgaaatggcctcagatgctatgaagagaggtgcttatttcttggaagcaattcaagcttctgatggtaactgggcctctgacttgggtggtcctatgttcttgttgccaggtttggttatcgctttatacgttaccggtgtcttgaactccgctttttctccagaacataagaaagaaatgatgagatacttatataatcaccaaaacgaggacggtggttggggtttgcatgttggtggtcactctaacatgttctgcactacctttaattacatttccttaagattgttgggtgaagaaccagatgtcgaagccgttgctaagggtagaatttggatccgtgatcatggtggtgttacttcaatcttgtcttggggcaaaacatggttgtctatattaaacttgttcgactggtccgcctcaaacccaatgccacctgaatattggatgttccctacctgggtcccaattcacccatctaatatgatgtgttacaccagaatcacttacatgccaatgtcctacttatatggcaagcgttttcaagctccattgactcctttagttttgcaattaagagacgaattacacacccaggcctacgagaagattaattggagaaaggttagacatatgtgtgctactgaggatttgtatttccctcacccattcgttcaagacttgttgtgggatacattgtacatgttatctgaaccattgatgactagatggccatttaacaaattgatcagacaaaaggctttggacgaaaccatgagacacattcattacgaagatgaaaactctcgttatatttgtttgggtccagtcgaaaaaccattgtgcatgttggcatgttgggtcgaggatccaaattccgaatacgtcaagaagcatttcgctcgtataccagactacttatggatggccgaagacggtatgagaatgcaaggttacaacggttctcagttgtgggatacagctttctcccaagcattattggcttgtaacataactcacgatatcggttcagctttgaataatggtcacgaatttattaaaaattcacaagttagaaacaaccctccaggtgatccaaacgtttggttcagacatatccacaaaggtgcttggccattctctactagagatcacggttggttgatctctgactgtaccgccgaaggcttaaaggcctccttgatgttgtccaagttgccttctaagattgttggtgagccattagaaaagtacgacgccgttaacgttttgttatcattacaaaatgaaaacggtggttttgcttcctatgaattgactcgttcctacccatggttggagttaatcaacccagctgaaacattcggtgatatcgtcattgactaccaacatgtcgaatgcacctcctctgctttgcaggcaatattattatttagaaagcaatatcctgaacacagaaagaaagagatcaataactttattaataaggccgttcaatttttacaagacattcaattgcctgatggttcttggtacggtaactggggtatttgttacacttatgctggttggttcggtattaagggtttggtcgctgctggtagaacctacaacaactgtgaagcattgagaaaaggtgccaatttcttgattaagatacaaaacccagaaggtggttttggtgaatcttatttgtcttgtccatataagagatacatccctttagacggtaagagatcaaacttggtccaaaccgcttggggtatgatgggtttgattgctgctggtcaagcagatgttgatccaggtcctatacatagagctgctaaattattaatcaattctcaaactgaagacggtgatttcccacaagaagaaatcatgggtgtcttcaacaagaactgcatgattacctacgcagctttcagagaagtttttccagttatggctttgggcgagtattgtaataaagttccattgccatctaagaagaacactattaattaa

SEQ ID NO: 20 - DNA, 2358 bp, Artificial Sequence
  Synthetic Polynucleotide
atgtggcgtttaaaagtcggtaaggaatccgttggcgagaaggaagaaaagtggattaaatcaatatctaaccatttgggtagacaagtttgggaattttgtgcagagaatgacgatgatgacgacgatgaagctgtcatccacgttgtcgctaactcttccaagcacttgttacagcaacaaagaagacaatcttctttcgaaaatgccagaaaacaattcagaaacaatcgttttcatagaaagcaatcctctgatttgttcttgaccattcagtacgaaaaggaaatcgccagaaacggtgctaagaacggtggtaacactaaggttaaagaaggtgaagacgttaagaaggaggctgtcaataacacattggaaagagctttatcattctattcagcaattcaaacttctgatggtaattgggcttccgacttgggtggtcctatgtttttattgccaggtttggtcatcgccttatacgttaccggtgttttgaactctgtcttgtccaagcaccacagacaagaaatgtgccgttatatttacaatcatcaaaacgaggacggtggttggggtttacatatcgaaggttcatccaccatgttcggttctgctttgaactatgttgcattgagattattgggtgaagatgctaatggtggtgaatgtggtgccatgactaaggctagatcttggatcttggaaagaggcggtgccacagctattacttcatggggtaaattgtggttgtctgttttgggtgtctacgaatggtctggtaataacccattaccacctgaattttggttgttaccatactccttgccattccacccaggtcgtatgtggtgtcattgcagaatggtttacttgccaatgtcttatttgtacggtaaaagattcgttggtcctataacccacatggtcttgtctttaagaaaagaattgtacactataccataccatgaaattgactggaaccgttccagaaacacttgtgctcaggaggatttgtattacccacacccaaagatgcaagatatcttgtggggttccatttaccacgtctatgagcctttgtttaatggctggccaggtagaagattacgtgaaaaggccatgaagattgctatggaacacatccattacgaagacgagaactcaagatacatttgtttaggtcctgttaacaaggttttaaacatgttgtgttgttgggttgaagatccatactctgatgctttcaagtttcacttacaaagaatcccagattatttgtggttggctgaagatggtatgagaatgcaaggttacaatggttcccaattgtgggacactgctttttctatccaagcaattttatctaccaaattgatcgatacattcggttccaccttgagaaaagcccaccatttcgtcaagcactcacaaatccaagaagactgtccaggtgatccaaatgtttggtttagacatattcataagggtgcttggccattctccaccagagaccacggttggttaatatctgactgtaccgctgaaggtttaaaggcctctttgatgttgtctaagttgccatctaaaatagttggtgaaccattggagaagaacagattgtgcgacgcagttaacgtcttgttgtccttgcaaaatgaaaatggtggtttcgcttcctatgaattaactagatcttatccatggttggaattaattaacccagccgaaacttttggtgatatcgttattgactactcttacgtcgaatgtacatcagctactatggaggctttagctttatttaagaaattgcacccaggtcatagaaccaaagagattgacgctgccttggctaaggctgctaacttcttagaaaacatgcaaagaaccgatggttcttggtacggttgctggggtgtctgtttcacttatgctggttggtttggtattaagggtttggtcgccgctggtcgtacttataataattgtgttgcaattcgtaaagcatgtcacttcttgttgtctaaggaattgcctggtggtggttggggtgaatcctacttatcctgtcaaaacaaggtttatacaaacttggaaggtaatagacctcacttagttaataccgcctgggtcttgatggcattgatcgaagctggtcagggtgagcgtgatcctgccccattacatagagctgccagattgttgattaactcccaattggaaaacggtgattttccacagcaagaaattatgggcgtcttcaacaaaaactgtatgataacatacgccgcttacagaaacatatttccaatctgggctttaggtgaatattcacacagagtcttgactgaataa

SEQ ID NO: 21 - DNA, 2277 bp, Artificial Sequence
  Synthetic Polynucleotide
atgtggaggttgaaggtagctgatggcggaaatgacccctacatagactcaacaaacaactttgtgggtcgtcaaatctgggagttcgatcctgattatggtactccggacgaacgcgccgaagtcgaagctgcaagagaaaacttctggaaaaatagatttcaggttaagttatctagtgaccttctatggagaatgcaattcgctagagaaaacccatgcgttaccaatttgccacaaattaaggtccaagatttggaggaagtgacggaagaagtcgtaaccactactctgaggagaggtttgaacttctactccaccattcaagcgcatgacggtcactggcctggtgattgtggtgggccaatgtttctattaccaggtttggttatcactttgtatgttactggtgccttacacgtcgttctttcgatcgagcaacagagagaaatgtgtagatacttgtgtaaccatcaaaacgaagatggtggttggggattgcacattgaaggcccatctaccatgtttggtacagttttgaattacgttaccctcagattattgggagaagctgacttcggtgctaaaggtgccatggaaaagggtcaaaagtggattctggatcatggcggtgctactgctattacgagctggggtaagatgtggttgtctgtcttaggtgcatatgaatggttcgggaccaacccattgcctccagaaatgtggttatgtccatacatccttccagttcacccgggtagaatgtggtgccattgtcgtatggtgtatttgcccatgtcctacttatacggtaaaaagttcgtcggcccaataaccagcactattatctcgcttcgtaaggaattgtacatcgttccatatcacgaagttgactggaatcaagctagaaatcagtgtgccaaagaggacttatattacccacacccattggtccaagatattttgtgggctagtttacataaggttttggagcctattcttggtcactggccaggtaacaatctaagagaaaaggccttatgtactgtgatgcaacacgttcattacgaagacgaaaacactagatacatttgcttgggccctgtcaacaaagtactaaacatgttgtgttgttggatcgaagatccaaactccgaagcttttaagttgcacataccaagaatcttcgattacctgtggatagctgaagatggtatgaaaatgcaaggttactctggttcacaattatgggacacgtcctttgctgttcaagctatcatttctactaatctaggtgaagaatatggtttgaccttgcgcaaggcacacgaatttattaagaactctcaggtcctggaggattgccctggtgacttgaagttctggtacagacacatctctaaaggggcatggccattctccacagccgaccaaggttggcctatctctgactgtacggctgagggcttgaaagccgtattattgctgagtaagcttccagttgaaaccgtcggggaaccattggatatgaagcatttgtcagatgctgttaatgtcattctatccttgcaaaatgcggatggtggtttcgctacttacgagcttactagatcttatcgttgggttgaactcattaaccctgccgaaacattcggcgacatagttatcgattacccatacgtggaatgtacctcggctgctatacaagccctcacttctttcaagaagctatatccggaacatagaagacatgaaattgaaaactgcatttctaaagctgcgaaatttattgaagaaatccaggctccagacggatcttggtatggttgttggggtgtctgttttacctatggtggttggttcggtatcaccggtttgattgctgccggtaatacatactccaattgtccatgtatcagaaaggcgtgtgattacttgttgagcaaggaattagcctcaggtggttggggtgaatcatacttatcctgtcaaaacaaggtctacacaaacctccctggagataagccacatatagttaacactgcttgggctatgctagctttgattgaagcaggacaagctggtcgtgacccgaatccattacacagagcagctcgaatcttgatcaatagtcaaatgaagaacggcgattttccccaagaagaaatcatgggagtgtttaacaaaaactgcatgattaactactctgcctatcgaaatatatttccaatctgggctctaggtgagcacagaagtagggtcttgcattcgtcctaa

SEQ ID NO: 22 - DNA, 2361 bp, Artificial Sequence
  Synthetic Polynucleotide
atgggtaatatcaaggaacgtaaaggaaaggatagagagagacaaagagaaatgtggaagttaaaaataggtggtgaatccgtcggtaagaacaacgaagaaaaatggttgaagtcaatttctaatcacttgggtagacaggtttgggaattttgcccaaagttagaaaccgagactgaaacagagactgaatctcaaattgaaaacgcccgtaacaccttccatttgaacagattccacaaaaagcaatcctctgacttgtttatcactttgcaatatggtaatgaaattgctaaaatcgaaggtgttaagattaaggaaaaggaagaagtcagagaggaagctgttaaaactacattggagagagcattaaatttctactccgccatccaaacctcagacggtcattgggcttctgatttgggtggtcctatgttcttgttaccaggtttggttattactttgtacgtcaccggtgttttaaactccgtcttgtctaagcaccatagacaggaaatatgtagatatttgtacaaccaccaaaatgaagatggtggttggggtttacatatcgaaggtccatctactatgtttggttctgttttgaactacgtcgctttacgtttgttggctcaagactccgagtacgattccattttgaaaggtagaagatggatcttggaccacggtggtgcaacaggtattacctcatggggtaagttatggttgtccgttttaggtgtttatgaatggtgtggtaacaatccattgccacctgaattttggatcttgccatacttcttgccattccaccctggaagaatgtggtgtcactgccgtatggtttatttgccaatgtcttacttgtacggtaagagattcgtcggtccaattacccctactgtcttatctttgagaaaggaattatatacagtcccatatcatgaaattgactggaacaaatcccgtaatacttgtgctaaggaggatttatactacccacatcctaaaatacaagacatcttgtgggcttctttacatcacgtttacgaaccattctttaccagatggccaggtaagagattgagagataaggccttgcacgccgctatgcaacacatccattatgaagatgaaaatactagatatatttgtttgggtccagttaacaaagttttgaacatgttgtgttgttgggtcgaagaccctcactcagacgcttttaagtttcatttgcaacgtgtttacgattacttatgggttgctgaagatggtatgaagatgcaaggttacaatggttcacaattgtgggatactgctttctctgtccaagcaatcatctctaccaagttgactgaaaacttcggtccaacattaagaaaggcccataatttcattaagttgtcccagattcaacaagactgtccaggtgatccaaacatttggtatagacacatccataagggtgcttggcctttctctactgctgatcacggttggttaatttctgattgcaccgccgagggtttaaaggcatctttattattgtccaaagtctcttccaacacagttggtgaaccattggaacgtaacagattatttgacgctgtcaacgttttgttgtctttgcaaaacaagaatggtggtatagcctcatacgagttgactagatcttatccatggttagaattgatcaatcctgctgaaacctttggtgacattgttatcgactacccatatgttgaatgcacttctgctaccattgaagcattggctttgttcaaaaagttgtacccaggtcacagaaccaaggaaattgacaacgtcatagctaaggccgctaaattcttagaagatatgcaaagagaagatggttcttggtacggttgttggggagtttgttttacatacgcaggttggttcggtatcaagggtttggttgctgctggtagacaatataataattccccaaccattcgtaaggcatgtaacttcatattgtccaaagagttgccaggtggtgttggtggttggggtgagtcatacttgtcatgccagaacaaagtctacaccaatttggatggtaacagaccacatttggttaacacatcctgggctttgatggctttgatcgaagctggtcaggccgaccgtgacccaacccctttacatagagctgccagattgttgatcaactcccaattggaaaacggtgactttccacaacaagaaattatgggtgtcttcaacaagaattgtatgatcacttacgccgcttacagaaacatttttccaatctgggccttaggtgaatactgtcacagagtcttgaaccagcacagatcttctccattgttttaa

SEQ ID NO: 23 - DNA, 2310 bp, Artificial Sequence
  Synthetic Polynucleotide
atgtggaagctaaaaattggtggcgaatctgttggtaagaacaatgaggaaaaatggcttaagtcgataagcaaccatctgggtcgacaggtgtgggaattttgtcctaagttagaaacagaaaccgaaactgagacggaatcccaaatcgaaaatgcccgtaacaccttccacctcaacagattccacaagaaacaatcatccgacttgttcatcacattgcaatacggaaatgagattgctaagattgaaggtgtcaaaatcaaggaaaaggaagaagtaagggaagaagcagttaagactactttggaaagagctttaaacttttatagtgctatacaaacttctgatggtcattgggcctctgatttagggggtcccatgttcttgttgccaggtttggtcattaccctgtacgttaccggtgttttaaatagtgtcttgtctaaacaccacagacaagaaatctgccgctacttgtataaccatcaaaatgaggacggcggttggggtttgcacattgaaggtccatccactatgtttgggtctgttctcaactacgtggctcttagattgttagctcaggactccgaatatgattcgattctaaagggtcggagatggatccttgatcacggtggtgcaacaggcatcacttcttggggaaagttatggttgtcagttttgggtgtctacgaatggtgtgggaacaacccactacctccagaattttggatcttaccatatttcttgcccttccatccaggtcggatgtggtgtcattgccgtatggtttacctgccaatgtcctacttgtacggtaaaagattcgtaggtccaattactcctaccgtcctatctttgagaaaggaactctatacggtgccataccacgagattgactggaataagtcaagaaacacctgtgccaaagaggacctgtactatccacacccgaagattcaagatattttgtgggcttccctgcatcatgtttacgaaccattttttaccagatggcctggtaaaagattgcgtgacaaggctcttcacgccgctatgcaacatatccactacgaagatgagaatactagatatatatgtttgggtccagtcaacaaagttctaaacatgttgtgttgttgggttgaagatccccattcggatgcgttcaagttccacttacaaagagtctacgactatctgtgggtcgctgaagacggtatgaagatgcaaggttataatggaagccaattgtgggacaccgcatttagtgtacaggctataatttctaccaagctcactgaaaattttggcccgactttaagaaaggcgcacaacttcatcaagttgtcacaaattcaacaagattgtccaggtgatccaaatatttggtacagacatatccacaagggtgcctggccgttctctaccgctgatcacggttggcttatctccgattgcacggctgaaggtttgaaagcttctctattgttgtctaaagtttcgtctaacacagttggggaacctttagagagaaaccgcttatttgacgctgtcaatgttttgttgtccttgcaaaacaagaacggtggaatagcttcctacgaattgactagaagctacccatggcttgaattgatcaatccagccgaaacattcggtgacattgtcattgattacccatacgttgaatgtacctcagctactatagaagctttggcccttttcaagaagttgtatcctggtcaccgaactaaggagattgacaatgtcatcgcgaaggccgctaaattcttggaagatatgcaaagagaagacggttcatggtacggatgctggggtgtgtgttttacgtatgcaggttggtttggtattaagggtttagttgctgccggtagacagtataacaactctccaactataagaaaggcttgtaatttcatcttaagtaaagagttgccaggtggtgtcggcggttggggtgaatcttatctgtcttgtcaaaacaaggtatacaccaacctagacggtaaccgtccacatttagtcaacaccagttgggctttgatggccctaattgaagctgggcaggctgaccgagaccccactccactccacagagcggcaagactgttgatcaatagtcaattagaaaatggtgatttcccacaacaagagattatgggtgttttcaacaagaactgcatgattacttacgctgcttacagaaatatcttccccatttgggcgcttggcgaatactgtcatagagttttaaaccaacaccgctcctctccactcttctaa

SEQ ID NO: 24 - DNA, 2280 bp, Artificial Sequence
  Synthetic Polynucleotide
atgtggcgtttaaaggttggtgccgaatctgtcggagagaacgatgaaaaatggttgaagtcaatttccaatcatttgggtagacaagtttgggaattttgccctgacgctggtactcagcaacaattgttacaagtccacaaggctagaaaagcattccacgatgacagattccatagaaagcaatcctctgacttgtttatcaccatacaatacggtaaagaagttgaaaacggtggtaagacagctggtgtcaagttgaaagaaggtgaagaggttcgtaaggaagccgttgagtcttctttagaaagagcattgtccttctattcctcaatccaaacttcagatggtaactgggcttctgatttgggtggtccaatgttcttgttgccaggtttggttattgctttatacgtcactggtgtcttaaattccgttttgtctaaacaccatagacaagagatgtgtagatatgtttacaaccaccaaaatgaagacggtggttggggtttgcacattgaaggtccatctaccatgtttggttcagccttaaactacgttgctttgagattgttgggtgaagatgctaacgctggtgcaatgccaaaggctcgtgcctggatcttggaccatggaggtgctactggtataacctcttggggtaagttatggttatccgtcttgggtgtctatgaatggtctggtaataaccctttgccaccagaattttggttattcccatacttcttaccattccacccaggtagaatgtggtgtcattgtagaatggtctatttgcctatgtcttacttgtacggtaagagatttgttggtccaatcacacctattgttttatctttgagaaaggaattatacgccgtcccatatcacgaaattgattggaataaatcaagaaacacctgtgctaaggaggacttgtactaccctcatccaaaaatgcaggatattttgtggggttccttgcaccatgtttatgaaccattattcactcgttggcctgctaagagattgcgtgaaaaggccttgcaaactgctatgcaacacatccactacgaagatgaaaacactagatacatctgtttgggtccagtcaataaggtcttgaacttgttatgctgttgggttgaagacccatactccgacgcttttaaattacacttgcaaagagttcatgattacttatgggttgctgaggatggtatgaagatgcagggttataacggttctcaattgtgggacaccgcattttcaatacaggctattgtctctactaagttagtcgataattatggtccaaccttgagaaaggctcatgacttcgttaagtcctcccaaatccaacaagattgtccaggtgacccaaacgtctggtacagacacattcataaaggtgcttggcctttctctactcgtgatcatggttggttaatctccgattgcaccgctgaaggtttgaaggcagccttgatgttgtccaagttaccatctgaaactgttggtgaatctttggaaagaaacagattgtgtgacgccgttaatgttttgttgtccttacaaaacgataatggtggatttgcctcttacgaattaacaagatcatacccatggttggagttgattaacccagctgaaacattcggtgatatcgtcattgattatccatacgtcgaatgcacctctgctaccatggaagctttgactttgtttaaaaagttgcacccaggtcatagaaccaaggaaattgacactgctattgttagagcagctaacttcttggaaaacatgcaacgtactgacggttcttggtacggttgttggggtgtttgttttacatacgccggttggttcggtatcaagggtttggttgccgcaggtagaacctacaacaattgtttggctataagaaaagcttgtgacttcttgttatccaaggaattgccaggtggtggttggggtgaatcatacttgtcctgtcaaaataaggtttatactaatttggaaggtaacagacctcacttggttaataccgcctgggtcttaatggctttgatagaagctggtcaagctgaaagagacccaactcctttacaccgtgctgcaagattgttgatcaactcacagttagaaaatggtgattttcctcaacaagagataatgggtgttttcaacaagaattgcatgattacctatgccgcttatcgtaacatcttcccaatttgggcattaggtgagtactgtcatcgtgttttaacagagtaa

SEQ ID NO: 25 - DNA, 2298 bp, Artificial Sequence
  Synthetic Polynucleotide
atgtggagattaaaagttggtgctgatacagtcccagccgacccttccaatgctggaggttggttgtcaactttgtctaaccacttgggtcgtcaagtttgggaattttgcgcagagttaggttctccagaagatttgcagcaaatccaacatgctagacaaagattctctgaccacagattcgaaaagaagcattccgccgatttgttaatgagaatgcaatttgctaaggaaaactcttcattcgtcaacttgccacagattaaagttaaggacaaagaagatgttatagaggaagctgttacccgtactttgagaagagcaattaatttttactccaccatccaagctgatgacggtaactgggcctctgatttgggtggtccaatgttcttattgccaggtttggtcattgctttatatgttactggtgtcttgaactctgttttgtccactgaacaccaacgtgaaatatgtagatacttatataatcatcagaacagagacggaggttggggtttgcacatcgagggtccttctaccatgttcggttcagtcttgaattacgttactttgagattattaggtgaagaagctgaagatggtcaaggtggtgttgacaaggccagaaagtggattttggatcacggtggtgctacagctattacctcctggggtaaaatgtggttatctgtcttgggtatctacgaatgggccggtaataacccattaccacctgaattgtggttgttgccatatttgttgccatgtcatcctggtagaatgtggtgtcactgtcgtatggtttacttaccaatgtgctacttgtatggtaaaagatttgtcggtccaattaccccaatcataagatcattaagaaaggagttgtacttggtcccatatcacgaagttgactggaacgaagccagaaatcaatgtgctaaggaagacttgtactacccacatccattagttcaagatgtcttatgggcttccttgcaccatgtttatgagccattgttcatgagatggcctgctaagagattgagagaaaaggctttgagatccgttatgcagcatatccactacgaagatgaaaactctcgttatatttgtttgggtccagtcaataaggtcttaaacatgttgtgttgctgggccgaagatcctcactctgaagcattcaagttgcatatcccaagaatctacgactacttgtggattgcagaagacggtatgcgtatgcaaggttataatggttcacaattgtgggacactgcattctctgttcaagctataatttctaccaagttggctgaagagtacggtactaccttaagaaaagctcacaaatatatcaaggattctcaagttttggaagattgtcctggtgacccaaacgtttggtttagacacattcataagggtgcttggccattttccacacgtgatcacggttggttgatctctgattgtactgccgaaggtttgaaggcctcattaatgttatctaagttgccatccaaaattgtcggtgaaccattagagaaggaaagaatatacgatgctgttaacgtcttgttatccttgcagaacgaaaacggtggtttcgcttcctacgaattaactagatcatatccatggttggaattaattaatccagccgaaacttttggtgacattgttattgactacccatatgtcgaatgtacctccgctgctatccaagccttggctgccttcaagaaattgtacccaggacacagatctaatgagataggtaactgtatcgctaaggccgcagatttcatcgaatctatccaagctactgatggttcttggtacggttcttggggtgtttgtttcacatacgctggttggtttggtattaagggtttggttgctgccggtagaacctataataactgttcatctttaagaaaagcatgcgacttcttattatcaaaggaattggccgctggtggttggggtgaatcctacttgtcttgccaagacaaagtctacactaatatcaaggatgaccgtcctcacattgttaacaccggttgggctactttgtccttgattgacgctggtcaagctgaaagagatccaacccctttgcaccgtgccgctagagttttaattaactctcaaatggacgatggtgactttccacaagaagagattatgggtgtcttcaacaagaattgcatgatcacttatgccgcttatagaaacatatttccaatatgggctttgggtgagtacagatgtcgtgttttacaagcaccataa

SEQ ID NO: 26 - DNA, 2277 bp, Artificial Sequence
  Synthetic Polynucleotide
atgtggcgcttaaagattgcagagggtggaaacccgtggctgagaactaccaatgatcatgtcgggcgtcaagtttgggaatttgaccctgaattgggttcaccagaagaattgtctgctatagaattggctcggagagatttcacgaaaaacagattcgaacacaagcacagcgccgacctattaatgaggatccagttttccaaggagaatccattggaaagagtgcttccccaagtaaaattgaaggaaaaagaagatgttacaaaggaagctgttaagagtaccctagaaagagcgctttctttctactccgctgtccaaacttcggacggcaactgggcctctgacttaggtggtccaatgttcctcttgccaggtttggtcattgcactatctgttactggtgctatgaacgctgttctttccgaacaacataagtccgagatgagaagatatttatacaatcaccaaaacgaggatggtgggtggggcttgcatatcgaaggtcctagtacaatgtttggttcagtattgtcttatgtcaccctgagattgttgggtgaaggtgctaatgatggtgaaggtgccatggaaaaaggtagagattggattgtcaatcacggtggagccaccgctatcacttcttggggtaagatgtggttaagcgttttgggtgtctttgaatggagtgggaacaacccattgccaccagagatttggttgctgccttacatgttaccaatccatccgggtcgtatgtggtgccactgtagaatggtttacttgcctatgtcttatctatacggcaaaagattcgtcggtccaataactccaactgttttgtctttacgaaaggaattgttctccacgccctatcacgaaattgactggaatagagcgagaaacgaatgtgcaaaggaggacttatactacccacatccattgattcaagacttgctttggggttctctacacaactttgtggaacctatcctcatggcttggcctggaaagaagctaagagaaaaagcattgcgcaccaccctggaacacatccactatgaagatgaaaatactcgttacatttgtttgggtccagtgaacaaggttttgaacttgttgtgctgttgggtagaagacccatacagcgatgctttcaaattgcatttacaaagagtccacgattatttgtgggttgctgaggatggcatgaagatgcagggttacaacggttcgcaattgtgggacactgccttctccatccaagctatcctgtctacaaacttaattgaagaatacgcttcgacccttaaaaaggctcatgcctttgttaaagactcacagatacaagaagattgtccaggtgatccaaacgtttggttcagacatattcacaagggtgcttggccattctccaccagagaccacggttggcttatctctgattgtactgccgagggtcttaaggcttcgttgatgttatctaagctgccctcaacgatggtgggcgaaccactagaagctaataggttgtgtgacgccgtcaatgttcttctgtcattacaaaatgacaacggtggttttgcttcctacgaattgactcgttcctacccatggctcgaacttataaatcctgctgaaacattcggtgacattgttattgattacccatatgttgaatgcacatccgctaccatggaagcactgactctcttcaagaagttacaccccggtcatagaactaaagagattgacacctgtatcaagaaagccgtcgcgtttttggaaaaaatgcaaagagcggatggttcatggtatggttgttggggtgtttgttttacttacgctggttggtttggaatcaaggggttggttgctgctgggcggacctacaactcttgtttggccataagaaaggcttgcgagttcctcttgtcaaaggaattaccaggtggtggttggggtgaatcttatttgtcttgtcaaaataaagtctacactaacttggaaggtaacaagccacatttggtaaacaccgcctgggtcttgatggctttgattgaagccggacaagccgaaagagatccagctccactgcacagagctgctaggtttttaattaactctcaaatggaaaatggtgacttccctcagcaagagatcatgggggtgtttaacaggaattgcatgatcacgtattcggcttatagagatatcttccctatttgggccttgggtgaataccgcacgaaggttttgcatgccagcagctaa

SEQ ID NO: 27 - DNA, 2280 bp, Artificial Sequence
  Synthetic Polynucleotide
atgtggcgtttaaaaatctcggagggaggcaatccttggttgaggacgacaaacaaccacgtcggtagacaggtgtgggaatttgacccagaactaggtagtccagaagaactctctgccattgaattggcacgaagagatttcaccaagaatagattcgaacaaaagcattcagcggaccttctgatgagaatacaattttctaaggagaaccccttggaaagagttttgccacaagtaaaattgagagaaaaggaagatgttactaaggaagctgtcaaaagcaccttagagagagctttgtccttctactctgctgttcaaacttccgatggtaattgggctagcgacttaggtggtccaatgtttctactgccaggtctagttatcgccttgtctgtcaccggtgctatgaacgctgttttatcagaacaacacaagtctgaaatgtgccgctatctttacaaccatcaaaacgaagatgggggttggggcttgcacattgaaggtccttccactatgttcggttcggttttgtcttatgtcactcttagattgttgggtgaaggaccgaacgacggtgaaggtgctatggggaagggacgggattggattttaaatcatggtggggctacagcaatcacctcctggggtaaattgtggttgagcgtcttgggtgtgttcgagtggtctggaaataacccactcccacccgaaatctggttattaccttacatgctaccaattcacccaggtaggatgtggtgtcactgtagaatggtttacctgccaatgtcctatttgtacggtaagagatttgttggtccgataactccaacagttttgtctttgagaaaggaattgttctccactccatatcacgagatcgattggaatagagcgcgtaacgaatgtgccaaggaagacttatactacccacatcctttaattcaggacttattgtggggttcattgcacaacttcgtagagccaattttgatggcatggccgggtaaaaaattgagagaaaaggctctgcggaccaccctagaacatattcattacgaagacgaaaacacaagatatatatgcctgggtccagtcaataaggtcttgaaccttttgtgttgttgggttgaagatccttacagtgacgcctttaagttacacttacaacgtgtacacgattacttgtgggtcgctgaagacggtatgaagatgcaaggctacaatggttctcaactctgggatactgctttctccatccaagctattttgtcaactaacctcgtagaagaatacgcctccacattgaaaaaggctcacacctatgttaaagacagccaaatccaggaagattgtccaggcgatcctaatgtttggtttagacatatacataagggtgcctggccattctctactagagaccatggttggttgatttcagattgtacagcagaaggcttaaaggcttcactaatgctttctaagttgccatctactatggtcggggaaccattggaagctaaccggctctgcgacgctgttaatgtcttgctatcgttacaaaacgacaacggtggtttcgctagctatgagttgaccagatcttacccatggttggaactgatcaatcctgcggagacatttggcgatatagttattgactacccgtatgtcgaatgtaccagtgccactatggaagctcttactttatttaaaaagttgcaccctggtcaccgtacgaaggaaatcgatacctgcattaaaaaagctgtcgccttccttgaaaagatgcaaagagctgatggttcttggtatggttgttggggtgtttgtttcacttacgcaggatggttcggtatcaagggtttagtcgcggctggtagaacgtataattcctgtttggctatcaggaaggcgtgcgaatttttgctaagtaaagaattgcccggtgggggctggggtgaatcttaccttagttgtcaaaacaaggtatacaccaacctagaaggtaacaagccacatcttgttaacactgcttgggtgttaatggctttgattgaggctgggcaagccgagagagatccggccccattgcacagagcagctagattcttgattaactcccagatggaaaacggtgattttccacaacaagacatcatgggtgtttttaatcgcaactgtatgataacctatgctgcttacagggacattttcccaatttgggctttgggtgaataccgtactaaggttttgcacgcaagcccttcctaa

SEQ ID NO: 28 - DNA, 2289 bp, Artificial Sequence
  Synthetic Polynucleotide
atgtggagattaaaagttggtgcagagtccgtcggggaaaacgacgaaaagtgggttaagtctatatcaaatcatttgggtcgtcaggtctgggaattttgcccagatgctggtacccctcaacaattgttgcaaattgaaaaggccagaaaagctttccaagacaacagattccacagaaagcaaacttctgatttattggtttctatccagtgtgaaaaaggtactacaaacggtgctagagtcccaggtaccaagttgaaggagggtgaagaagttcgtaaggaagccgttaagtccactttggaaagagctttatccttttattcttcaatccaaacatctgacggtaattgggcttctgatttgggtggtccaatgttcttattgccaggtttggttattgccttatgtgtcaccggtgctttgaactccgtcttgtccaaacaccatagacaagagatgtgtagatacttgtacaatcaccaaaacgaagacggtggttggggtttacatattgaatccccatctactatgtttggttccgcattgaactacgttgctttgagattattgggtgaagatgccgatggtggtgaaggtcgtgctatgaccaaagctagagcctggatcttggggcacggtggtgctaccgccatcacttcttggggtaagttatggttatcagtcttgggtgtctatgaatggtctggtaataatcctttaccacctgaattttggttgttgccatacttcttgccattccaccctggtagaatgtggtgtcattgcagaatggtttatttaccaatgtcctacttgtacggtaagcgtttcgttggtccaataactccagtcgttttgtctttgagaaaggaattgtatactgttccttaccacgagattgactggaacaagtcaagaaacacctgtgctaaagaagatttatattacccacattctaagatgcaagatattttgtggggttctattcaccatatgtacgagccattgtttacccactggcctgctaaaagattgagagaaaaggctttgaagacagcaatgcagcacatccattacgaagacgaaaatactagatatatctgtttgggtccagttaacaaggtcttaaatatgttgtgttgctgggttgaagacccatattctgaagccttcaagttgcacttacaaagagtccacgattacttgtgggttgctgaagacggtatgaaaatgcaaggttacaacggttcacaattgtgggacaccgcattctccgttcaagctattatctctactaagttagtcgataactacggtccaactttgcgtaaggctcatgactatgtcaaaaactctcaaatccaacaagattgtccaggtgaaccaaacgtctggttcagacacattcacaagggtgcttggccattctccaccagagatcacggttggttgatttctgattgcacagctgaaggtttaaaagcatctttgatgttatccaagttgccttccgagacagttggggaacctttagaaagaaatcgtttatgtgatgccgttaatgttttgttgtccttgcagaacgacaatggtggttttgcatcatatgaattgactagatcttacccttggttggagttgattaacccagctgagacttttggtgacatcgttattgattacccatatgttgaatgtacttctgccaccatggaagctttagctttgttcaagaaattgcatccaggtcaccgtaccaaagaaatcgacacagcaatcgctcgtgctgctgattttttggagaacatgcaaagaactgacgggtcttggtacggttgttggggtgtctgtttcacttacgctggttggttcggtattaagggtttggtcgctgccggtagagcatattccaactgtttggctattagaaaagcctgtgatttcttattgtcaaaggaattgccaggtggtggttggggtgaatcttacttgtcctgtcagaacaaggtttatactaacttagaaggtaatagaccacacttggttaataccgcctgggttttaatggctttgatagaggctggtcaaggtgaaagagatcctgccccattgcacagagcagctcgtttattgatcaactctcaattggaaaacggtgattttccacaagaagaaatcatgggtgtctttaataagaactgcatgattacctacgctgcatatagaaacatattcccaatctgggctttgggtgagtactgtcatagagttttaactgaataa

SEQ ID NO: 29 - DNA, 2112 bp, Artificial Sequence
  Synthetic Polynucleotide
atgggttctaataacttcgtcggccgtaagatgtggagattaaaattgggtgaaggtgcaaacaatccttatttgtggtcatccaacaactttgttggtagacagacttgggacttcgaggccgatgaaggtacaccagaagaaagagctcaaatagaagctgctagaaagacctactttcaaaacagattcaaagttcaatgttctaatgatttattctggaagtttcaagttttcgccttctacattactggtcatttgggtaccatctttccagaggaacaccaaaaggaattgttacgttatgcttactgccaccagaacgaagacggtggttggggtttgtacattatgggtgagtcctgtatgttatgtactgtcttgaattatatccaattgagattgttgggtgaagaaccagataccgacgcttgtaacagagcccgtaagtggattttggatcatggtggtgctttatacattccttcttggggtaagatctggttgtccatattgggtgtttacgaatgggacggtgctaacccaatgccaccagaattttggttattcggtaatgctttaccattgaaaccaggtcacttgttgggttactctcgtttgactttattgccaatgtcctatttatatggcaagagatttgtcggtacattaactcctttgattttgcaattgagacaagagatctacacccaaccatactctaatatcaaatggtcacctgccagacactactgtgctaaggaagataagtgcttcgaaagatcatggattcaaaagttggcatgggacgctgttcattacttaggtgaaccattgttgggctcttgggcattcaaatctgttagaaacagagctttgcaaattgccagatttcatatcgattatgaagaccaaaattcccactacatcacaatcggttgtgtcgaaaagccattgtgtactttggctacctgggtcgacgatccaaacggtcaggcctacaagaagcacttagctcgtgttaaggattacttgtggattggtgaagacggtatgaaaatccaatcattcggttctcaatcttgggatgttgctttcgctattcaagccattttggctaccaactttcatagagaattttctgatactttaaaaaagggtcatgatttcataaagaagtcccaaattagagagaatccttctggtgatttccaatccatgtatagacacatctcaaaaggttcctggtctttctctgaccaagatcacggttggcagttgtccgactgcactgctgaaaacttaacttgttgcttaatcttatctacaatgccaccagatatggtcggtgaccctatgaagccacaatgttttttcgatgcagttaatattatcttgtccttacaggccaagaacggtggtgtctccgcttgggaacctaccggtatcgtttcatcttggtttgaaagattgaatccagttgaatttttagaatattctattttggaattggaatacgtcgaatgtacttcttcctctttgcaagccttggttttgttcaaaaagttattcccaaaccacagaaaaaaagaaatcgagactttcataaccaagggtgtcaactatattaaggaaatgcaaaaagacgatggttcttggtacggtaactggggtatttgtcatttgtacgctacctacttcgcaattaaaggtttagttgctgttggttactcttacgactcctgttccacaataagaagaggtgtcgactttttgttaaagatccaatgtccagatggtggttggggtgaatcacatgtctcagtcaccaagaaggtttatactcctttgcaacacaacgcttccaacttggttcaaacttcattcgctttgatggctttgatccacgctcaacaagccaatagagatccaacaccagttcacagagcagctaagttgttgataaactctcaattagaagacggtgactaccctcaacaagaaattactggtgcatttatgggtaattgtatgttgcattatccattgtataaaaacgtcttcccattgtgggctttggccgattattgcaacttggttcctttgccataa

SEQ ID NO: 30 - DNA, 2271 bp, Artificial Sequence
  Synthetic Polynucleotide
atgtggaaactaaaggtggcagagggtggcaccccatggttacggacattgaacaatcacgttggacgtcaagtctgggaatttgaccctcattctgggtccccacaggatttggatgacattgaaactgccagaagaaacttccacgataaccgattcacgcataagcacagtgacgatctgcttatgagattgcaatttgctaaggaaaatcccatgaacgaagttttacctaaagtaaaggttaaggatgtcgaagacgttactgaagaggctgtcgctaccactttgagaaggggtctcaacttctattcgaccatacaatctcacgacggtcattggccaggtgatttgggtggtccaatgtttcttatgccaggtttggttatcactttgtcagtaaccggtgctttaaatgccgtcttaacagatgaacatagaaaagaaatgagaagatacttgtacaatcatcaaaacaaggacggtggctggggtttgcacatcgagggtccgagcacaatgttcggatctgttctgtgttatgtcactttgagattgcttggtgaaggtccaaacgatggtgaaggggacatggaacgtggtagagactggattttagaacacggtggtgcgacttacatcacgagttggggtaagatgtggctaagcgttttgggcgtctttgagtggtccggtaacaatccaatgccaccagaaatttggctacttccttacgctctaccagttcacccaggtagaatgtggtgccactgtagaatggtatatttgcccatgtcctacttatacggcaaacgcttcgttggtcccattacccctacggtgttgtctttgaggaaggaattgttcactgttccatatcatgacattgattggaaccaagctcgcaatctttgtgcaaaagaagatttgtactatccacatccattggtccaggatatcctgtgggccaccttacataagtttgttgaaccagtcttcatgaactggccgggtaagaaattaagagagaaggctataaaaactgccattgaacacatccactacgaagacgaaaatacacgttatatatgtatcggacctgtcaacaaggttctcaacatgttgtgttgctgggttgaggatccaaattctgaagctttcaagttgcacttaccaagaatttacgactacttgtgggtggctgaagatggtatgaagatgcaaggttataacggttctcaattatgggacaccgcgtttgctgcccaagctataatcagtactaatttaattgatgaatttggaccgactcttaagaaggctcacgcattcattaagaactcacaagtgtccgaagattgtccaggtgacttgtctaagtggtacagacatatctcaaagggggcctggcccttttccaccgctgaccacggttggccgatctctgattgtaccgctgaaggtttgaaggctgttttgctactatccaagattgcgccggaaattgtcggtgaaccactggactctaaacgtttgtacgacgccgtgaatgttatcttgtccttacaaaacgaaaacggtggcctcgctacttatgagctaacgagatcctacacttggttggaaattattaatccagctgaaacattcggtgacattgttatagactgcccatatgtagagtgtacctctgctgctatccaggcactagccaccttcggcaaactatacccaggtcatcgaagagaagaaatacaatgttgcatcgaaaaagctgtcgcgttcattgaaaaaattcaagcttcagatggttcatggtacggttcttggggagtctgtttcacttacgcaacttggtttggtatcaaaggtttgatcgctgccggtaagaacttctcgaactgtttgtctataagaaaggcttgcgaatttttgttgtccaagcaattgcctagcggtggctgggccgaaagttatctttcctgtcaaaataaggtttattctaatttagaaggtaacagatcgcacgttgtgaacacaggttgggctatgttggcattgattgaagccgagcaagctaagagagatccaacgcctttgcaccgtgcggctgtttgtttaattaactctcaactcgagaacggcgatttccctcaggaagaaatcatgggtgtctttaacaaaaattgtatgattacttacgccgcttaccgttgtatttttccaatctgggctcttggtgaatacagaagagttctgcaagcctgctaa

SEQ ID NO: 31 - DNA, 2295 bp, Artificial Sequence
  Synthetic Polynucleotide
atgtggcgtttgaaagtcggagccgagagtgttggcgaagaagatgaaaagtgggtgaagtccgtttctaaccacttaggtaggcaggtatgggaattttgtgctgacgcggcagccgacaccccacatcaactgttgcaaatccaaaatgctagaaaccacttccatcacaatagattccatagaaagcaatcgtctgatctttttttggctatacaatatgaaaaagaaattgctaagggtgctaagggtggtgccgttaaagtcaaggaaggtgaggaagtcgggaaagaagctgttaagagcacactagaaagagctttgggtttctactccgctgtacaaactagagatggtaactgggcatccgacctaggtggtcccttatttttgttacctgggttggttattgcgctccacgtcactggtgttttgaatagtgtcttgtctaagcatcaccgtgttgaaatgtgcagatacctatacaaccatcagaacgaggatggtggttggggtttgcacatcgaaggcacctctaccatgttcggttcagcccttaactatgtcgctttaagactgctcggagaagacgctgacggtggggatggtggtgccatgacgaaggctcgagcttggattttggaacgcggtggtgccactgctatcacatcttggggcaaattgtggttgtcagttttaggtgtttacgaatggagcggtaataatccattaccaccagaattttggttgctaccgtactcattgccattccaccctggtagaatgtggtgtcattgtagaatggtctatttgccaatgtcctacttgtacggaaagagattcgttggtccaataactcctaaagttctttctcttagacaagaattgtatacaattccataccacgaaattgactggaacaagtctcgcaatacctgcgccaaagaggatctgtattacccacatcctaagatgcaagacatcttgtggggttctatttaccatgtgtacgaaccattatttactcggtggccgggcaagaggttaagagagaaagcccttcaagctgcaatgaagcacatccactatgaagatgaaaactcgcgttacatatgtttgggtccagtcaacaaggtcttgaacatgctttgttgttgggttgaagatccatattccgacgcattcaaattgcatttgcagagagtgcacgactacttatgggttgctgaagatggcatgagaatgcaaggatacaatggttcgcaattgtgggacactgctttcagtatccaagctattgttgctaccaagttagtcgattcctacgctcctaccttaagaaaggcccacgatttcgttaaggattcccaaattcaggaagattgtcccggtgatccaaacgtgtggtttcgacacatccataaaggtgcatggccattgtctactagagaccatggttggttaatctctgactgtacggctgaaggtctcaaggcctccttgatgttgtctaaattaccttcgactatggtaggtgaaccactggaaaagaacaggttgtgcgacgctgttaacgttctattatcactccaaaatgacaacggcggtttcgcctcttatgagttgactagatcatacccatggttggaattgattaatccagctgagaccttcggtgacatcgttatcgactatccatacgtcgaatgcactgccgctacaatggaggctttgactttattcaagaaactgcaccctggtcatagaacgaaggaaattgatactgccattggtaaggctgctaattttctggaaaaaatgcaacgtgcagatggtagttggtatggctgttggggtgtctgtttcacctatgctggttggtttggtataaagggattagttgctgcgggtagaacctataattcttgtcttgcgatcagaaaagcttgtgagttcttgctatctaaggaattgcccggaggtggctggggtgaaagctacttgtcctgtcaaaacaaggtctacaccaacttggaaggtaacaagcctcacttggttaacactgcttgggtattaatggccttgattgaagctggacaaggggaaagggatccggcgccattacatagagctgcaagattgctaatgaacagccaattggaaaatggtgatttcgtacaacaggaaattatgggtgtattcaataagaattgcatgattacgtacgccgcctatcgtaacatctttccaatctgggcgctaggtgagtactgtcatcgagtgctaacggaataa

SEQ ID NO: 32 - DNA, 2295 bp, Artificial Sequence
  Synthetic Polynucleotide
atgtggcgtttgaaggttggtgctgagtctgtcggagaaaaagacgaaaagtgggtcaaatccgtttcaaatcacttaggtagacaagtttgggaattttgcgccgatgctgatgcagttacccctcatcagtctttgcaaattcacaacgctagaaaccatttccaccaaaatagattcagaagaaagcaatcttccgacttgtttttagctatacaatatgaaaaggagatcgccaagggtgttaaggtcggtgctgttaaagtcaaagaaggtgaagaagttggtaaggaagcagtcaagtctacattggagcgtgctttgtcattctactccgctgtccagacttctgatggtaactgggcctctgacttaggtggtccaatgttcttgttgccaggtttagttattgccttgtacgttactggtgttttaaattccgtcttgtccaagcaccatagattggaaatgtgtagatatttatacaaccatcaaaacgaagatggtggttggggtttgcacatcgaaggttcttccaccatgtttggttcagctttgaactacgtcgctttaagattgttgggtgaagacgttgatggtggtgatggtggagctatgactaagggtagagcatggattttggaccgtggttctgccactgccatcacctcttggggtaaattatggttgtccgttttgggtgtctacgagtggtccggtaacaacccattacctccagaattttggttgttgccatattctttaccattccacccaggtagaatgtggtgtcactgtagaatggtttacttgccaatgtcatatttgtacggtaagagattcgttggtcctataacaccaattgtcttatctttgagaaaggaattgtacaccgttccttaccatgaaatcgactggaataagtccagaaatacttgtgctaaagaagacttgtattacccacacccaaaggtccaagatattttgtggggtactatccaccatgtttacgaaccattgttctctggttggccatgcaaacgtttgagagaaaaggctttgcaaactgccatgaaacacattcactacgaagatgagaactctaactatatctgtttaggtcctgttaacaaggttttgaatatgttatgttgctgggttgaagacccatattcagacgcttttaagttgcatttgcaaagaatccatgatttcttatgggtctctgaggatggtatgaagatgcaaggttacaacggttcacagttgtgggataccgctttttccattcaagccattgcttctacaaagttggttgacacatacggtcactcattaagaaaagcacacaatttcgtcaagaactctcaaatacaacaggattgtccaggtgattccaatgtctggtttagacacatacataaaggtgcttggccattctctacccgtgatcacggttggttaatctccgactgtactgctgaaggtttaaaagcttcattgaccttatctaagttgccatcccaattggttggtgaacctttggaaaagaacagattgtatgacgcagttaatgtcttgttgtcattacaaaacgaaaacggtggtttcgcttcctacgaattaactagatcttatccttggttggagttgattaacccagcagaaacttttggagatattgttatcgattattcttacgttgaatgcactgctgccaccatggaggctttggcattattcaagaagttacacccaggtcatcgtaccaaggaaatcgatacctgtattgctaaggccgccaacttcttggaaacaatgcaaagaactgacggttcttggtatggttgttggggtgtttgtttcacctacgctggttggtttggtatcaaaggtttgatcgctgctggtagaacatacaagacctgtattgctataagaaaggcctgcgattttttattgtctaaagaattgcctggtggtggttggggtgaatcttacttgtcatgtcaaaacaaggtctacactaatttggagggtaatcgtccacacttggtcaatactgcttgggtcttgatggccttgattgaagctggtcaagctaaaagagaccaggccccattgcatagagccgctcgtttattaattaattcacaattggaaaatggtgacttccctcaacaagaaataatgggtgtttttaacaagaattgtatgatcacttatgctgcttacagaaacatctttccaatttgggccttgggagagtattaccatagagttttgactaaataa

SEQ ID NO: 33 - DNA, 2280 bp, Artificial Sequence
  Synthetic Polynucleotide
atgtggagattgaaagtaggtgctgaatccgtaggtgaaaacgacgaaaagtggttgaaaagtataagtaatcatttgggtagacaagtctgggaattttgtccagatgcaggtacacaacaacaattgttgcaagtacataaggctagaaaggcatttcatgatgacagattccacagaaagcaatcttcagatttgttcatcaccatccaatacggcaaggaagtagaaaacggtggcaagactgctggtgttaaattgaaggaaggtgaagaagttagaaaagaagcagttgaatccagtttggaaagagccttgtctttctactcttcaatccaaacctctgatggtaattgggcatcagacttgggtggtccaatgttcttgttacctggtttggtcattgccttgtacgtaactggtgttttgaactctgtattgtcaaagcatcacagacaagaaatgtgtagatacgtttacaaccatcaaaacgaagatggtggttggggtttgcacattgaaggtccatccactatgtttggtagtgcattgaattatgtcgccttaagattgttaggtgaagatgcaaacgccggtgctatgcctaaggcaagagcctggatattagaccatggtggtgctactggtatcacatcctggggtaaattgtggttaagtgtcttaggtgtatatgaatggtctggtaataacccattgccacctgaattttggttgttcccttactttttaccattccatcctggtagaatgtggtgtcactgcagaatggtttacttgccaatgtcttacttgtacggcaagagattcgttggtccaataacacctatcgtcttgtcattgagaaaggaattgtacgcagttccttaccatgaaatcgattggaacaagtccagaaacacctgtgctaaggaagatttgtattacccacaccctaaaatgcaagacattttgtggggtagtttacatcacgtttacgaaccattatttactagatggcctgctaaaagattgagagaaaaggcattacaaacagccatgcaacatatccactacgaagatgaaaacaccagatacatctgcttgggtccagttaacaaggtcttgaacttgttgtgttgctgggttgaagatccttattctgacgctttcaagttgcatttgcaaagagtacacgattacttgtgggttgcagaagacggtatgaaaatgcaaggttacaatggttcacaattgtgggatacagctttttccattcaagcaatagtcagtactaagttggtagataactacggtccaacattaagaaaagctcatgacttcgtaaagtccagtcaaatacaacaagattgtccaggtgaccctaatgtttggtatagacatatccacaaaggtgcatggccattttctaccagagatcatggttggttgatttcagactgtactgctgaaggtttgaaggctgcattgatgttgtctaagttgccatcagaaactgttggtgaatccttggaaagaaatagattatgcgatgccgttaacgtcttgttgagtttgcaaaacgacaacggtggtttcgcttcttacgaattgactagatcatacccatggttggaattaattaatcctgctgaaacattcggtgatatcgtcattgactatccatacgtagaatgtacctccgctactatggaagcattgaccttgttcaagaagttgcatcctggtcacagaacaaaggaaatcgataccgcaattgttagagccgctaatttcttggaaaacatgcaaagaacagacggttcttggtatggttgttggggtgtttgctttacctacgctggttggttcggtattaaaggtttagtcgcagccggtagaacatacaataactgtttggccataagaaaagcttgcgatttcttgttatctaaggaattaccaggtggtggttggggtgaatcctacttgagttgtcaaaacaaggtttacactaatttggaaggcaacagacctcatttagttaacacagcctgggtcttgatggctttaatcgaagccggtcaagctgaaagagatccaactcctttgcatagagctgcaagattgttgatcaactcacaattggaaaacggtgattttccacaacaagaaatcatgggtgttttcaacaagaactgcatgataacatatgccgcttacagaaacatttttcctatatgggctttgggtgaatactgccacagagtcttgaccgaataa

SEQ ID NO: 34 - DNA, 2280 bp, Artificial Sequence
  Synthetic Polynucleotide
atgtggaggcttaaagtaggcgcggaatcagtcggggagaatgacgaaaagtggctgaaaagcattagtaaccacttgggtcgccaggtgtgggaattttgcccagatgcaggtacgcaacaacaactattacaggttcataaggctagaaaagccttccatgatgaccgttttcacagaaagcaatcgtccgatttattcatcaccatacaatatggaaaagaggttgaaaatggaggtaagacagctggcgtaaaactcaaggagggtgaagaagttagaaaggaggcagtcgaatcttctttggaacgggctttatcgttttactcttcaattcaaacttccgatggtaactgggccagtgacctgggtggtccgatgtttttactacccggcttggttatcgccctttatgtaaccggcgtcctgaatagcgtgctatccaaacatcataggcaggaaatgtgtcgatacgtttataaccaccaaaatgaggatgggggttggggattacatattgaaggaccttcaacaatgttcgggtctgcacttaattatgtcgctttgagactcttaggcgaagacgcaaacgctggtgccatgccaaaagcaagagcgtggatattggatcacggaggtgcgactggtatcacgtcatggggcaaactttggctctcggttttaggagtgtacgagtggagtggcaataatcctctaccacctgaattttggctgtttccttatttcttgccgttccatcccgggcgaatgtggtgtcattgcagaatggtatatttaccaatgagttacctctatggtaagcgttttgtaggtccaattactcctatagttttgtctttacgcaaagaactatacgctgtcccataccatgagatcgattggaacaagtcgcgtaatacatgtgctaaagaagatctttattacccccacccgaaaatgcaggacattctgtgggggtcattgcatcacgtttatgagcccttatttaccagatggccggcgaaaagactaagggaaaaggctttgcaaactgccatgcaacatatacactacgaagatgaaaacacaagatacatttgtttagggcctgtaaataaagtgttgaatttactttgctgttgggtagaagacccatatagcgatgcatttaagctccatttgcagagggttcacgactatttatgggtcgctgaagatggaatgaaaatgcaaggttataatggatctcaattgtgggacacagcatttagcattcaggccattgtctctactaaactcgttgataactacggcccaacgctacggaaggcccatgatttcgtgaaaagcagtcagatacaacaagattgccctggcgatccaaacgtgtggtataggcatatacacaagggtgcttggccattctcaacaagagatcatggttggctgatctccgattgtacagctgagggattaaaggcggcattaatgttgtctaaattaccgagtgaaaccgttggtgagagcttggaaagaaatagactgtgtgatgccgtgaatgtgttgctttccctgcaaaatgacaatggaggtttcgcgtcgtatgaactaactcgatcttatccttggttagaacttatcaaccccgcagaaacctttggggatattgttatcgattatccatacgtggagtgtacttcagcaaccatggaggctttgacactgtttaaaaaacttcatcctggacatcgtactaaggaaattgatacggccatagtacgcgcagctaactttctagaaaatatgcaaagaactgatggtagttggtacggttgctggggcgtttgtttcacttacgctggctggtttggaattaaaggtctagtagctgccggacgtacatataacaattgcttggccattagaaaggcttgtgactttctcttatcaaaagaactacctggtggtgggtggggagagtcttatcttagctgccagaacaaagtatatactaatttggaaggcaacaggccacaccttgttaacacagcatgggtattgatggctctgattgaagctggtcaagctgaacgagacccaacgcccttacacagagcagcaagactgctgatcaattcacagttagaaaatggtgatttccctcagcaagagatcatgggcgtttttaacaagaattgtatgattacttacgccgcatatcgtaacatatttccgatttgggcattaggggaatactgccatagggtgcttactgaataa

SEQ ID NO: 35 - DNA, 2292 bp, Artificial Sequence
  Synthetic Polynucleotide
atgtggcgtttgaaagttggtggtgagtctgtcggagaaaaggaagaaaagtgggttaaatcaatatccaatcatttaggtagacaagtctgggaattttgccctcacgatggtacaccagaacagagattgcaagttcaaaaggcaagagacgctttcttcagaattaacagatttcgtagaaagcaatcttccgatttattcttggctatccaatatgaaaaggagatcgccaacggtgctaccgtcggtggtattaaattgaaggagggtgacgaagttagaaaggaagccgttaagtctactttagaacgtgctttgaatttttactctgctgttcagactaccgacggtaactgggcttccgatttgggtggtccaatgttcttattgccaggtttggtcatcgcattatacgttactggtgtcttgaactctgtcttgtcaaaaaatcacagacaagaaatgtgtagatatttgtacaaccatcaaaacgaagatggtggttggggtttgcacattgaaggtccttccaccatgttcggttctgctttaaactacgttgccttgagattgttgggtgaagatgccgacggtggtgacggtggtgctatgactaaggctagagcttggatcttggacagaggaggtgccaccgccattacatcttggggtaaattgtggttatcagttttaggtgtttatgagtggtctggtaataatccattaccaccagaattttggttgttgccatatttcttaccattccatccaggtcgtatgtggtgtcactgtagaatggtctacttacctatgtcctacttgtacggtaagagatttgttggtcctattactccaatcgtcttgtccttgagaaaggaattgtataccgtcccataccacgaagttgattggaacaagtccagaaatacttgtgctaaagaggatttgtactatccacatccaaagatgcaagacatcttgtggggttctatacaccatgtttacgaacctttgttttcaagatggccaggtaagagattaagagaaaaagctttacaatctgcaatgcagcacattcactatgaagatgaaaacactagatacatatgtttaggtccagttaacaaggtcttgaacatgttgtgctgttgggttgaagatccttactctgatgctttcaagttgcatttacaaagagtccatgactacttatgggtttctgaagatggtatgaaaatgcaaggttacaacggttcccaattgtgggacactgccttctcaattcaagctattgcttcaacaaagttagttgactcttatggtccaaccttgagaaaggcacacgacttcgtcaaaaactctcaaatccagcaagattgtccaggtgattccaatgtctggttccgtcatatccacaagggtgcctggcctttctctactagagaccacggatggttgatttctgattgcaccgctgaaggtttgaaggcttcattgatgttgtctaagttaccatccgaaatagtcggtccatctttggagaaaaacagattgtgtgatgcagttaatgttttgttgtctttgcaaaatgacaacggtggttttgcttcctacgaattaacccgttcttacccatggttagaattgatcaacccagcagaaacattcggtgacatcgtcattgattattcatacgttgaatgtacttccgctacaatggaagctttgaccttgtttaagaagttgcacccaggtcatagaactaaagaaattgacaccgccatcggaaaggctgccaacttcttggagaagatgcaacgtactgatggttcttggtacggttgctggggtgtttgtttcacttacgctggttggtttggtattaaaggtttggttgctgctggtagaacatacaattcctgtatagctattcgtaaggcatgtgatttcttgttgtccaaggaattaccaggtggtggttggggtgaatcttacttgtcttgtcaaaacaaagtttacactaatttggaaggtaacagacctcacttagttaacaccgcctgggtcttgatggccttgatcgaagctggtcaagctgagagagaccctgctcctttgcacagagctgccagattattgataaattcccaattagaaaacggtgatttcccacaagaagaaattatgggtgtttttaataagaactgtatgatcacctatgcagcttatagaaacatctttccaatttgggccttaggtgaatactgccatagagttttaactgagtaa

SEQ ID NO: 36 - DNA, 2328 bp, Artificial Sequence
  Synthetic Polynucleotide
atgggtagacgtgagagatggggcggtagaagagaaataatgtggagattgaaagttggtggtgaatccgtcggtgaaaaggaagaaaagtgggttaaatctatttcaaaccacttaggtagacaagtttgggaattttgtccacatgacggtacacctgaacagcgtttgcaagtccaaaaggcaagagatgctttcagaatcaatcgtttcagaagaaagcaatcttctgacttgtttttggctatccaatacgagaaggaaattgccaacggtgctactgtcggtggtattaaattaaaggagggtgatgaagtcagaaaagaagccgttaagtccaccttggaaagagctttaaacttctattccgctgttcaaactaccgatggtaattgggcctctgacttgggtggtccaatgtttttattgcctggtttggttatcgctttatacgtcactggtgttttgaactctgttttgtcaaagaatcaccgtcaggaaatgtgcagatacttgtataaccatcaaaacgaagacggtggttggggtttgcacattgaaggtccatccaccatgttcggctctgcattaaattacgttgctttaagattgttgggtgaggatgctgatggtggtgacggtggtgctatgacaaaggcacgtgcctggatcttggacagaggtggtgctactgctataacttcatggggtaaattgtggttgtccgtcttgggtgtctatgaatggtccggtaacaatccattgccaccagaattttggttattaccatacttcttgcctttccacccaggtagaatgtggtgtcattgtagaatggtttatttgcctatgtcatacttgtacggtaagcgtttcgtcggtccaattaccccaattgttttgtctttaagaaaggaattgtacactgttccataccacgaggttgattggaataaatctcgtaacacttgtgccaaggaagacttgtactatccacacccaaaaatgcaagatatcttgtggggttctatccatcacgtctacgaaccattattttctcgttggcctggtaagagattgagagaaaaggctttacaatctgctatgcagcatattcattatgaggatgaaaacaccagatacatttgcttgggtcctgttaacaaagttttaaatatgttgtgttgttgggttgaagatccatattcagatgcatttaagttgcacttgcaaagagttcacgactacttatgggtctccgaagatggtatgaagatgcaaggttacaatggttcccaattgtgggacacagccttctctatacaagctatcgcttcaacaaagttagtcgattcttatggtccaaccttaagaaaggctcatgactttgtcaaaaactctcaaattcaacaagattgcccaggcgattccaacgtctggttcagacatatacacaagggtgcctggccattctcaactagagaccacggttggttgatttccgactgtactgccgaaggtttgaaggcttctttaatgttatctaagttgccatctgaaatcgttggtccttctttagagaaaaacagattgtgtgacgctgttaacgtcttattgtccttgcaaaacgataatggtggttttgcatcttacgaattaaccagatcctacccttggttggaattgattaatccagcagaaactttcggtgacatcgttattgactactcttatgttgaatgtacatccgctaccatggaagctttaactttgttcaagaagttgcacccaggtcatagaaccaaagaaatcgacaccgccataggtaaggctgctaacttcttggagaagatgcaacgtactgacggttcttggtacggttgctggggtgtctgtttcacttacgccggttggtttggtatcaagggtttagtcgctgctggtagaacttataactcctgtatcgctattagaaaggcatgtgattttttgttgtctaaggaattacctggtggtggttggggcgagtcttacttgtcctgtcaaaacaaagtctacactaacttagaaggtaatagaccacacttggttaatactgcatgggtcttaatggctttgattgaagccggtcaggctgaaagagacccagccccattgcatagagctgcccgtttattgattaattcacaattggagaacggtgatttcccacaagaagaaattatgggtgtcttcaacaaaaactgcatgataacctatgctgcatacagaaatatctttccaatctgggctttgggtgaatattgtcacagagttttgacagaataa

SEQ ID NO: 37 - DNA, 2274 bp, Artificial Sequence
  Synthetic Polynucleotide
atgtggaaattgaaggtcgccgagggtggctctccatggttacgtacattgaatggtcacattggtagacaagtttgggaatttgaccctaacttgggttccccaaaggatttagaagaaatagaaaagttcagagcagaattttataaaaacagattcgaaactaagcattcatctgatttgttaatgagataccagttctcaaaggaaaacccagttggtaccatcttgccaagagtccaagttaaggacatcggtgatattaccgaggacaatgtcgctactaccttgcgtagagctatttccttttactctactttgcaagctcacgatggtcattgggccgctgactgtggtggtccaatgttcttgttacctggtttagttatcgctttgtctgttacaggtgccttgaacgctgtcttgtctgaagaacacaaaagagagatctgccgttacttatataatcatcaaaactgtgacggtggttggggtttgcacattgaatcccactcaactatgttcggttctgtcttatcttacgttactttgagattgttaggtgaaaaggcaaatggtggtgaaggtgctatggagaagggtagaaaatggatattggatcatggtaccgccactgctattacttcctggggtaagatgtggttgtccgttttgggtttgtttgattggtctggcaacaacccattgcctccagaaatgtggttattgccatacattttgccattccatccaggtagaatgtggtgtcactgccgtatggtttatttacctatgtcttacttatatggtaaaagatttgtcggtccaatcacccctacagttttgtctttaagaaaggaattgttcactgtcccataccacaagatcaattggaacaaggctagaaacgaatgtgctaaggaagatttgtattacccacaccctttgttgcaagacatattatggacttccttggataaattgatcgaaccattgttcatgcattggccaggtaaaaaattgagagaaaaggccttatccaccgttatggaccacattcactacgaagatgaaaatacccgttatatttgtttgggtccagtcaataaggttttaaacatgttatgttgctgggtcgaagattcatcttctgaagcttttaagttacatttgccaagattgtacgactatttatggattgcagaggacggtatgaaaatccaaggttataacggttcccaatcatgggatacctccttcgctatacaggccattatttctactaatttggtcgaggaatacggcccaacattaagaaaggcacacaagtttatgaaaaactcccaagttttggacgattgtcctggtaacttggacttctggtaccgtcacatctcaaagggtgcttggccattctccactgctgatcatggttggccaatttctgactgtacagctgagggtttgaaagcctgtttattgttgtcaaagttgcctgttgaaatcgttggtgaaccattgaaggctaacagattgtacgatgcagttaatgtcatgttatctttgcaaaatccagatggtggtataggtacctacgaattgtctcgttcatatccatggttggaaattatcaatccagctgaaacctttggtgacatcgttatcgattacccatatgttgaatgtacctctgccattatccaggctttagctgctttcaagaaattataccctggttatagaaaggaggatgtcgaaagatgtattgaaaaaggtgctgccttcatagagaagattcaagaagctgacggttcttggtacggttgctggggtgtttgttttacttacggtacttggtttggtgttaagggtttgttggatgcaggtagaaactttaacaactcctacaacattagaaaggcctgtgatttcttattatccaagcaagtcgtctccggtggttggggtgaatcttatttatcttgtcagaacaaggtttataccaacttgaagggtaacaagtctcattccgtttgtacagcttgggctatgttggctttgattgaagcaggtcaaggtgagagagaccctactccattacatagagctgccaaagtcttgattaattctcaattagaaaatggtgatttcccacaacaagaaatctctggtgtcttcaacaaaaactgcatgatctcctactctgcatacagaaatattttcccaatctgggctttgggtcaataccaatctcaattgttgaatccacaataa

SEQ ID NO: 38 - DNA, 2307 bp, Artificial Sequence
  Synthetic Polynucleotide
atgtggaaattgaaggttgcagccgagggtgggggtggtcctttattgagatctactaatcgttttgtcggtagaacagtttgggaatttgaaccagatttaggtaccccagaacaaagagctgaagtcgagaaggctagaagagacttctcagatcatagattccagcgtagacactccgctgacgttttgatgcgtatgcaaatgcaacaatactctaaaggtactccattgaagttagatttgccagctgtcaagaagttgggtgaagacgaagatgttactgaagaagccgtttccacctctttgaagagagctatcaacagagtctctgctttacaagcccacgacggtcattggccaggtgattgttccggtcctttgttcttgttgccaggtttaattataaccttgtatgttacaggtgccttgaacgcagtcttatcatctgaacaccaaagagaaattagaagatacttatacaatcaccaaaacgaagatggtggttggggtttgcatatggaaggtcactccgctatgttgggtactaccttgaattatgttgcattaagattaatcggtgagggtccagactctggtggggacgatggtgctgctatggaaagaggtcgtaactggattttgcagagaggtggtgccacttacacaacttcatggggtaaattctggttgaccgttttgggtgtctacgactggtccggtaacaatccattgcctcctgaaatgtggttgttgccatatcatttaccatttcatccaggtagaatgtggtgccactgtcgtgctgtttatttgccaatgtcttacgtttacggtaagagattcgtcggtcgtatcactccattggttttagagttgagaaacgaattgtacggtgatccatattcattgatagattggaataaagctagaaaccaatgtgctaaggaagatttgtattacccacactcctttttacaagacgttttgtgggctaccttgcataaattcgtcgaacctgttatgatgcattggccaggtattaagttcagagaaatcgccttaagaaccgctatgagacacatccactacgaagacgaatctacacgttacattaacttgggtcctgtcaacaaggttttgaacatgttagcttgttggattgaggatccaaattctgaagcttttaagttgcacgtcccaagaatttatgattacttgtggttagctgaagacggtatgaagatgaaaggttacaacggttctcagttgtgggacgctggtttgactgttttggccatcgttaataccgacttaatcgaggaatttggtccaactttaaagttggcccatgcattcgtcaaaaactcacaaataattgacaattgtttggaagatttgaaccaatggtatagacacatgtctaaaggtggttggcctttttccaccgctgaccacggttggtgcgtttccgattgtactgcaactggtttagaagccaccttgttattgtctactatatccccacaaatcgtcggtgaggctatggaagttggtagagtttacgatggggttaactgtttgatttcattgatgaacaataatggtggtttcgcaaccttcgaattgactagatcctatgcttggttagaacatattaacccttcagaaactttcggtggtatcatgatcgattacccatacgtcgaatgcacatcttcttctatacaagccttagcattattcaagaagttgtacccaagacacagaactgaagagatcgactcttgtatttccaagggtgctaactttattgagtcaatgcaaagaaatgatggttcttggtatggttcttggggtgtctgttttacttacgctacatggttcgctgttttcggtttggcttgtgccggtagaacatttgaagattccccagctataaaaaaggcttgcgaatttttattatctaaggaattgccatccggtggttggggtgaatcttacttgtcctgtcaagataaggtctacaccaatttggaggggatgagacctcatgccgtcaacacatcttgggctatgttggctttgattcgtgttggtcaagctgaaagagacccagcaccattgcacagagctgcaagagttttgattaacttgcaatccgaagacggtgaatttccacaacaggagatcatcggtgttttcaatcagaactgtatgattggttactctcaatatagaaacatcttcccaatttgggctttaggtgaataccgtactaaagtccatgtcccacgtaaaaagtaa

SEQ ID NO: 39 - DNA, 2274 bp, Artificial Sequence
  Synthetic Polynucleotide
atgtggcgtttgaagtttgctgagggtggatcaccatggttaagaacaactaataaccatgttggtagacaagtctgggaatttgaccctagattgggtaccccagaagaattggcagaaatagaggaagctagaaaatccttcgccgaaaacagattcgttcacaagcactcttctgatttattgatgcgtttacagttctccagagagaatccagtcagacaagttttgccacaagtcgaagttaaggatactgacgatatctctaaagaagctgtcaagtctaccttggaaagagccttgtcattctattcagctgttcaaacttctgacggtaactgggcatctgacttaggtggtcctatgtttttgttaccaggtttggtcattgctttgtccatcaccggtgctttgaatgccgttttatccgaacaacataagcaagaaatgtgccgttacttgtacaaccaccagaacgaagatggtggttggggtttacatattgaaggtccttctactatgttcggttctgttttgaactatgttacaatgagattgttgggtgaaggtccaaacgatggtgacggtgctatggaaaagggtagagactggattttgaatcacggtggtgctacctacatcacctcctggggtaaaatgtggttaactgtcttaggtgtttttgagtggtctggaaacaatccattgcctccagaaatttggttgttgccatacatattaccaatccacccaggtagaatgtggtgtcattgtagaatggtctatttgccaatgtcttacttgtatggtaaacgtttcgtcggtcctattaccccaactgttttatccttgagaaaggaattattcaccgttccataccatgaggtcgattggaacaaggcaagaaatttgtgtgctaaggaagatttatactacccacacccagttgttcaagacattttgtgggcctctttgcataaggttgttgaaccaatattgatgcgttggccagtcactaaattgagagaaaaagcattaagaactgctatcgaacacatccattatgaagacgagaatacaagatatatctgcttgggtcctgttaacaaggtcttaaatttgttgtgttgttgggtcgaagatccttactcagatgcttttaagttgcacttgcaacgtgtccacgattacttgtgggtcgctgaagacggtatgaaaatgcaaggttataacggttctcaattatgggataccgccttttccattcaagctattttcgctactaactttgttgaagagtacggtgacgtcttgaagaaggctaactcctacataaaagattcccaaattcaagaggactgtccaggtgacccaaacgtttggttcagacacatccacaagggtgcctggcctttctctaccagagatcatggttggttaatctcagattgtactgctgaaggtttgaaagcctcattgatgttgtccaagttgccatctaccatggttggtgaaccattggaagctaatagattgtgcgacgcagtcaacgttttgttatcattgcagaatgataacggtggtttcgcttcctacgaattgacaagatcttacccatggttagaattaattaacccagccgaaactttcggtgacatcgttattgactatccatatgtcgaatgtacttctgcaaccatggaggctttaaccttatttaagaagttgcacccaggacatagaacaaaggaaatagatcaatgtatcaagaaggctgctaagttcttggaaaaaatgcaaagagcagatggttcctggtacggttgttggggtgtctgtttcacttacgctggttggtttggtataaaaggtttagttgctgccggtagaacttacaactcttgtttggcaattagaaaggcttgtgaatttttgttatctaaggaattgccaggtggtggttggggtgagtcatatttatcctgccaaaataaggtttacactaacttggaaggtaataagcctcatttggtcaacactgcctgggtcttgatggccttgattgaagctggtcaacacgaacgtgacccaaagcctttgcatcgtgctgctagatatttgatcaattcccaattagaaaatggtgatttcccacagcaagaaattatgggtgttttcaacaaaaactgtatgatcacatacgccgcttacagaaacatttttcctatttgggctttaggtgaatacagatctcaagttttgcaagctgcataa

SEQ ID NO: 40 - DNA, 1992 bp, Artificial Sequence
  Synthetic Polynucleotide
atggaccgtcagtcatttagagataatagattccatagaaagcaatcttccgatttgttcttagccatacaatttgcagaagagaaacaatctgtcactaacttgccacaaacaaagttagaagaatttgaagacgttaagaaagaggctgttaagtccaccttggaaagagctttgtctttctactccgctgtccaaacttctgacggtaactgggcctctgatttgggaggtcctatgttcttattgccaggtttggttattaccttatatgtcaccggtgctttgaatactgttttgtcaaaagaacaccagtacgaaatctgtcgttatttgtacaaccaccaaaacagagacggtggttggggtttacatatcgaaggtccatcaactatgtttggtacagttttgaattacgtttctttaagattgttaggtgaaggtgctgaaggtggtgagggtgctattgaaaaggctagacgtatgtggtgccactgtagaatggtctacttgccaatgtccttcttgtatggtaagaaattcgttggtccaattactcctaccatcttatccttgagaaaggaattatacaccgtcccataccatgaagttgattggaacaaggccagaaatgcatgtgccaaggaagatttgtattaccctcacccattggttcaagacattttgtgggcttctttgcactacttgtatgaaccaatgttgaagtactggccttgtaaatctttgagagagaaggccttacaaatcgttatgcaacatatccactatgaagacgaaaacactcgttatatttgcttaggtccagtcaataaagtcttaaacatgttgtgttgttgggtcgaggatccatactccgaatcttttaagttgcacttgccacgtatattggactacttgtggattgctgaagatggtatgaagatgcaaggttacaacggttctcaattatgggatacagctttcgctatacaagcaattatctccaccggtttagctgacgagtacggttccgttttgagaaaggctcatgacttcttaaaagattcacaaatccaagaagactgtccaggagatccaaacgtctggtttagacacattcataaaggtgcttggccattttctactagagatcatggttggttgatttccgattgcactgccgaaggtttaaaggcttctttgatgttgtctaagttgccatcaactatggtcggtgaacctttggaagttaatagattatgtgatgctgttaacgttttattgtctttgcagaacgacaatggtggtttcgcctcctatgaattaaccagatcatacccatggttggaattgattaacccagctgagaccttcggtgatatcgttatcgactacccatatgttgaatgtacctctgctactatggaagccttaacattgtttaagaaattacacccaggtcatagaacaaaggaaattgatataggtagagctgtcgaatttttggagaagatgcaaagagcagacggttcctggtatggttgttggggtgtttgcttcacttacgcaggttggttcggtatcaagggattggtcgctgctggtagaacctataattcctgtttggctattagaaaggcttgcgaatttttgttatctaaagaattacctggtggtggttggggtgaatcctacttgtcctgtcagaacaaggtttacacaaatttggaaggtaacaagccacacttggttaatactgcatgggtcttgatggcattaattgaggccggtcaagctgaacgtgatcctaccccattacacagagctgctaaaatcttaattaattctcaaatggaagacggtgatttcccacaagaagagatcatgggtgtttttaacaagaactgtatgatctcttactccgcttacagaaacattttcccaatatgggccttgggtgaatatcattgtcgtgtcttgcaggcaccataa

SEQ ID NO: 41 - protein, 756 aa, Artificial Sequence
  Synthetic Polypeptide
MWRLKIAEGGSPWLRTTNNHVGRQIWEFDPNLGTPEQIREVEEARENFWKNRFEQKHSSDLLMRMQFAQENSSNVVLPQVKVKDEDEITKEAVKSTLERALSFYSAVQTSDGNWASDLGGPMFLLPGLVIALSVTGALNAVLSKEHQKEMCRYLYNHQNKDGGWGLHIEGHSTMFGTVLTYVTLRLLGEGVDDGDGAMERGRKWTLEHGSATAITSWGKMWLSVLGVFEWAGNNPMPPETWLLPYILPVHPGRMWCHCRMVYLPMSYLYGKRFVGPITPTVLSLRRELFDVPYHEIDWDRARNECAKEDLYYPHPLVQDILWASLHKAVEPILMRWPGKKLREKALSTVMEHIHYEDENTRYICLGPVNKVLNLLCCWVEDPYSDAFKLHLQRVHDYLWVAEDGMKMQGYNGSQLWDTAFSIQAILATNLGEEYGGTLRKAHNFIKDSQIQEDCPGDPNVWFRHIHKGAWPFSTRDHGWLISDCTAEGLKASLMLSKLPSTMVGEPLEVNRLCDAVNVLLSLQNDNGGFASYELTRSYPWLELINPAETFGDIVIDYPYVECTSATMEALTLFKKLHPGHRTKEIDNCIKKAAKFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQAKRDPMPLHRAAKVLINSQMPNGDFPQQEIMGVFNRNCMITYAAYRNIFPTWALGEYRTQVLQK

SEQ ID NO: 42 - protein, 761 aa, Artificial Sequence
  Synthetic Polypeptide
MWRLKTGSETVGDNGRWLRSTNNHVGRQVWEFFPEMGSPEELVAIEAAHREFHLNRFHKQHSSDLLMRLQYEREKPCVQKEGAVRLDATETPTEAAVETTLRRALTFYSTMQSDDGNWASDLGGPMFLLPGLVIALYVTGVLNSVLSKEHQREIRRYLYNHQNQDGGWGLHIEGPSTMFGSALNYVTLRLLGEGPDDGEGAMERARQWILSRGGAVAVTSWGKLWLSVLGVYEWDGNNPLPPELWLLPYSLPLHPGRMWCHCRMVYLPMSYLYGKRFVGPITPTVLSLREELYPIPYHHVDWNKARNTCAQDDLYYPHPFVQDLLWGSLYHVYEPLVMRWPGKRLRERALQHVMKHIHYEDENSRYICLGPVNKALNMLCCWVEDPHSEAFKMHIPRIYDYLWIAEDGMRMQGYNGSQLWDTAFSVQAIVATKLTDEFSETLAKANKYILDAQILKNCPGDPNVWFRHIHKGAWPFSTRDHGWLISDCTAEGLKASLMLSKLPSKIVGEPLEKNRLYDAVNVLLSLQNENGGFASYELTRSYPWLELINPAETFGDIVIDYTYVECTSATMEALTLFKKLHPGHRKKEIERCMANAAKFLEMRQEADGSWYGCWGVCYTYAGWFGIKGLVAAGRTYNNCANIRRACDFLLSKQLPNGGWGESYLSCQNKLYTNLNNDRMHTVNTAWAMMALIEAGQAKTDPMPLHHAARTLINAQMETGDFPQQEIMGVFNKNCMITYAAYRNVFPVWALGEYHHRVLNGC

SEQ ID NO: 43 - protein, 761 aa, Aquilaria agallocha
MWRLKTGSETVGDNGRWLRSTNNHVGRQVWEFFPEMGSPEELVAIEAAHREFHLNRFHKQHSSDLLMRLQYEREKPCVQKEGAVRLDATETPTEAAVETTLRRALTFYSTMQSDDGHWANDLGGPMFLLPGLVITLTITGTINVVLSKEHQREIRRYLYNHQNQDGGWGLHIEGPSTMFGSALNYVTLRLLGEGPDDGEGAMERARQWILSRGGAVAVTSWGKLWLSVLGVYEWDGNNPLPPELWLLPYSLPLHPGRMWCHCRMVYLPMSYLYGKRFVGPITPTVLSLREELYPIPYHHVDWNKARNTCAQDDLYYPHPFVQDLLWGSLYHVYEPLVMRWPGKRLRERALQHVMKHIHYEDENTEYICLGPVNKALNMLCCWVEDPHSEAFKMHIPRIYDYLWIAEDGMKMQGYNGSQLWDTAFAVQAIVATKLTDEFSETLAKANKYILDAQILKNCPGDPNVWYRHITKGAWSFSTADQGWLVSDCTAEGLKALLLYSMLPHQKAPSSIEKNRLYDAVNVLLSMQNADGGFASFELTRSYPWLEMINPAETFGDIVIDYTYVECTSAVIQALALFKRLHPGHRKKEIERCMANAAKFLEMRQEADGSWYGCWGVCYTYAGWFGIKGLTSCGRTYNNCANIRRACDFLLSKQLPNGGWGESYLSCQNKLYTNLNNDRMHTVNTAWAMMALIEAGQAKTDPMPLHHAARTLINAQMETGDFPQQEIMGVFNKNCMISYAGYRNVFPVWALGEYHHRVLNGC

SEQ ID NO: 44 - protein, 741 aa, Aquilaria agallocha
MWRLKIAEGKEGPYLKSTNNFVGRQTWEFDPDAGTPEERAAVEEARRAFYSNRYRVKPPADLLWRLQFMREKNFKQIIPMVRIKDGEAITHEKATATLRRAVHFLTVLQSIDGHWPAENAGCHYFLPPLVFCLYITGHLSSVFSQEHQREILRYIYNHQNEDGGWGLHIEGHSIMFSTALSYICLRILGEGLEGGQDNACAKAQKWILDHGSVTHIPSWGKTWLSVLGLFDWSGSNPIPPEFWMLPSFLPIHPGKIWSYCRTTYMPMSYLYGKKFVAPITPLIIQLRKELYLQPYDEINWRKVRHLCAKEDLYYPHPVIQDLMWDCLYVFTEPLLNRWPLNKMIREKALKVTMNHIHYEDENSSYINMACVGKVLCTLACWVEDPNGDYFKKHLARIPDYIWVAEDGMTMQGLASQTWDSGLAIQALFASNLIDEIGPTLKRAHDFIKKSQVLDNPFGDFKKMFRHSSKGSWTFSVRDHGWPVSDCTAEGLKCCLLLSMLPQEIVGEKLEVERLHDAVNIIFHLQSKNGGVAAWEPVRASKWLELLNPIEFLEDIVVDHEYLECTASSIDALQLFKKLYPTCEREEIENFILKAVEYIENIQMSDGSWYGNWGVCFIYGTLFALKGLAKAGKTYDDCVAMRKGVDFLLRIQRDDGGWGESYKSCPNKKFEPLQREGSNVVQTAWAILGLIESRQIMRDPTPLHRAIKFIINSQLEDGDFPQQVRGLSYIYSSLSFLPVIKM

SEQ ID NO: 45 - protein, 766 aa, Artificial Sequence
  Synthetic Polypeptide
MWRLKIGADTVLTDPSNAGGRWLSTLSNHLGRQVWEFCAELGSPEDLQQIQHARQRFSDHRFEKKHSTDLLMRMQFAKENSSFVNLPQIKVKDKEDVTEEAVTRTLKRAINFYSTIQAHDGNWASDLGGPMFLLPGLVIALYVTGVLNSVLSTEHQREICRYLYNHQNRDGGWGLHIEGPSTMFGSVLNYVTLRLLGEEAEDGQGGVDKARKWILDHGGATAITSWGKMWLSVLGVYEWAGNNPLPPELWLLPYLLPCHPGRMWCHCRMVYLPMCYLYGKRFVGPITPIIRSLRKELYLVPYHEVDWNVARNQCAKEDLYYPHPLVQDVLWASLHHVYEPLFMCWPAKRLREKALRTVMQHIHYEDENSRYICLGPVNKVLNMLCCWVEDPHSEAFKLHIPRLYDYLWIAEDGMRMQGYNGSQLWDTAFSVQAIMSTKLSEEYGTTLRKAHKYIQDSQVQEDCPGDPNVWFRHIHKGAWPFSTRDHGWLISDCTAEGLKASLMLSKLPSKIVGEPLEKERLYDAVNVLLSLQNENGGFASYELTRSYPWLELINPAETFGDIVIDYPYVECTSAAIQALAAFKKLYPGHRSNEIGNSIAKAADFIESIQATDGSWYGSWGVCFTYAGWFGIKGLVAAGRTYNSCSSLRKACDFLMSKELAAGGWGESYLSCQDKVYTNIKDDRPHLVNTGWAMLSLIDAGQAERDPTPLHRAARILINSQMEDGDFPQEEIMGVFNKNCMITYAAYRNIFPIWALGEYRCRVLQAS

SEQ ID NO: 46 - protein, 764 aa, Citrullus colocynthis
MWRLKVGAESVGEKEEKWLKSISNHLGRQVWEFCAHQPTASPNHLQQIDNARNHFRNNRFHRKQSSDLFLAIQNEKEIANVTKGGGIKVKEEEDVRKETVKNTVERALSFYSAIQTNDGNWASDLGGPMFLLPGLVIALYVTGVLNSVLSKHHRQEMCRYLYNHQNEDGGWGLHIEGTSTMFGSALNYVALRLLGEDADGGEGGAMTKARSWILDRGGATAITSWGKLWLSVLGVYEWSGNNPLPPEFWLLPYCLPFHPGRMWCHCRMVYLPMSYLYGKRFVGPITPIVLSLRKELYTIPYHEIDWNRSRNTCAKEDLYYPHPKMQDILWGSIYHLYEPLFTRWPGKRLREKALQMAMKHIHYEDENSRYICLGPVNKVLNMLCCWVEDPYSDAFKFHLQRVPDYLWVAEDGMRMQGYNGSQLWDTAFSVQAIISTKLIDSFGTTLKKAHDFVKDSQIQQDCPGDPNVWFRHIHKGAWPFSTRDHGWLISDCTAEGLKASLMLSKLPSKIVGEPLEKSRLCDAVNVLLSLQNENGGFASYELTRSYPWLELINPAETFGDIVIDYPYVECTSATMEALTLFKKLHPGHRTKEIDIAVARAANFLENMQRTDGSWYGCWGVCFTYAGWFGIKGLVAAGRTYNSCVAIRKACDFLLSKELPGGGWGESYLSCQNKVYTNLEGNRPHLVNTAWVLMALIEAGQAERDPAPLHRAARLLINSQLENGDFPQEEIMGVFNKNCMITYAAYRNIFPIWALGEYFHRVLTE

SEQ ID NO: 47 - protein, 764 aa, Citrullus colocynthis
MWRLKVGAESVGEKEEKWLKSISNHLGRQVWEFCADQPTASPNHLQQIDNARKHFRNNRFHRKQSSDLFLAIQNEKEIANGTKGGGIKVKEEEDVRKETVKNTVERALSFYSAIQTNDGNWASDLGGPMFLLPGLVIALYVTGVLNSVLSKHHRQEMCRYLYNHQNEDGGWGLHIEGTSTMFGSALNYVALRLLGEDADGGEGGAMTKARGWILDRGGATAITSWGKLWLSVLGVYEWSGNNPLPPEFWLLPYCLPFHPGRMWCHCRMVYLPMSYLYGKRFVGPITPIVLSLRKELYTIPYHEIDWNKSRNTCAKEDLYYPHPKMQDILWGSIYHLYEPLFTRWPGKRLREKALQMAMKHIHYEDENSRYICLGPVNKVLNMLCCWVEDPYSDAFKFHLQRVPDYLWIAEDGMRMQGYNGSQLWDTAFSVQAIISTKLIDSFGTTLKKAHDFVKDSQIQQDFPGDPNVWFRHIHKGAWPFSTRDHGWLISDCTAEGLKASLMLSKLPSKIVGEPLEKSRLCDAVNVLLSLQNENGGFASYELTRSYPWLELINPAETFGDIVIDYPYVECTSATMEALTLFKKLHPGHRTKEIDTAVAKAANFLENMQRTDGSWYGCWGVCFTYAGWFGIKGLVAAGRTYSTCVAIRKACDFLLSKELPGGGWGESYLSCQNKVYTNLEGNRPHLVNTAWVLMALIEAGQAERDPAPLHRAARLLINSQLENGDFPQEEIMGVFNKNCMITYAAYRNIFPIWALGEYFHRVLTE

SEQ ID NO: 48 - protein, 764 aa, Cucurbita maxima
MWRLKVGAESVGEKDEKWVKSVSNHLGRQVWEFCADAAADTPHQLLQIQNARNHFHHNRFHRKQSSDLFLAIQYEKEIAKGAKGGAVKVKEGEEVGKEAVKSTLERALGFYSAVQTSDGNWASDLGGPMFLLPGLVIALHVTGVLNSVLSKHHRVEMCRYLYNHQNEDGGWGLHIEGTSTMFGSALNYVALRLLGEDADGGDGGAMTKARAWILERGGATAITSWGKLWLSVLGVYEWSGNNPLPPEFWLLPYSLPFHPGRMWCHCRMVYLPMSYLYGKRFVGPITPKVLSLRQELYTIPYHEIDWNKSRNTCAKEDLYYPHPKMQDILWGSIYHVYEPLFTRWPGKRLREKALQAAMKHIHYEDENSRYICLGPVNKVLNMLCCWVEDPYSDAFKLHLQRVHDYLWVAEDGMRMQGYNGSQLWDTAFSIQAIVATKLVDSYAPTLRKAHDFVKDSQIQEDCPGDPNVWFRHIHKGAWPFSTRDHGWLISDCTAEGLKASLMLSKLPSTMVGEPLEKNRLCDAVNVLLSLQNDNGGFASYELTRSYPWLELINPAETFGDIVIDYPYVECTAATMEALTLFKKLHPGHRTKEIDTAIGKAANFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQGERDPAPLHRAARLLMNSQLENGDFVQQEIMGVFNKNCMITYAAYRNIFPIWALGEYCHRVLTE

SEQ ID NO: 49 - protein, 774 aa, Cucumis melo
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 50 - protein, 723 aa, Coccinia grandis
MWRLKLGKGENEDYLFSTNDFIGRQTWEFDPNAGTPQERAQVEAARLNFYQNRNHVQCSSDLLWRFQFLEEKNFKQAIPKVVVEERNGNDRELSIKKETVKTALRRATNFFAALQSNHGHWPAENAGPLYYLPPLVFALYITRDLNTILSKEHQKEILRYVYCHQNEDGGWGLHIASRQSCMLCTVLNYIELRLLGEEADNEACSRARKWILDHGGALYIPSWGKIWLSILGLYEWEGTNPMPPEIWMFGKILPWNLGGLLCYTRLTLLPMSYLYGKRFVGPLTPLILQLRHEIYTQPYNDIKWSPARHLCAKEDEYFERSIFQKLVWDVVTYVGEPILKSWAFKKIRNRAIQIAKWYMDYEDQNSHYITIGCVEKPLFTLTSWVVDPHGEAYKKHLARIKDYLWVGEDGMKMQSFGSQSWDVAFAIQAILATNLHHEFSETLKKGHDFIKQSQVKKNPSGDFPRMYRHISKGSWTFSDQDHGWGVSDCAAENLLCCLKLSTMPSHIVGDSMEPQCFFEAVNFILSLQAKDGGLSAWEPAGTLPLWFEVLNPVEFFEYTVLEIECVECTSSAIQALVLFKKLFPSHRKKEIDNFIEKATNYIKEIQKEDGSWYGNWGICHIYGTYFAIKGLAAAGNTYENCSTVTKAVDFLLKIQCPDGGWGESHISCLNKVHTPLPGNASNLVQTSFALMSLIHSQQVCFFLFFFFPSFLPICTLPSLIIIF

SEQ ID NO: 51 - protein, 765 aa, Artificial Sequence
  Synthetic Polypeptide
MWRLKVGADTVPADPSKSGGWLSTLSNHLGRQVWEFCAELGSPEDLQQIQHARQHFSDHRFEKKHSADLLMRMQFAKENSSFVNLPQIKVKDKEDVMEEAVTRTLKRAINFYSTIQADDGNWASDLGGPMFLLPGLVIALYVTGVLNSVLSTEHQREICRYLYNHQNRDGGWGLHIEGPSTMFGSVLNYVTLRLLGEEAEDGEGGVDKARKWILDHGGATAITSWGKMWLSVLGVYEWTGNNPLPPELWLLPYLLPVHPGRMWCHCRMVYLPMCYLYGKRFVGPITPIIRSLRKELYLVPYHEVDWNEARNLCAKEDLYYPHPLVQDILWASLHHVYEPLFMRWPAKRLREKALRTVMQHIHYEDENSRYICLGPVNKVLNMLCCWVEDPHSEAFKLHIPRVYDYLWIAEDGMRMQGYNGSQLWDTAFSVQAIISTKLAEEYGTTLRKAHEYIKDSQVLEDCPGDPNVWFRHIHKGAWPFSTRDHGWLISDCTAEGLKASLMLSKLPSKIVGEPLEKERIYDSVNVLLSLQNENGGFASYELTRSYPWLELINPAETFGDIVIDYPYVECTSAAIQALAAFKKLYPGHRSNEIGNCIAKAADFIESIQATDGSWYGSWGVCFTYAGWFGIKGLVAAGRTYNNCLSLRKACDFLLSKELAGGGWGESYLSCQDKVYTNIKDDRPHIVNTGWAMLSLIEVGQAERDPTPLHRAARILINSQMDDGDFPQEEIMGVFNKNCMITYAAYRNIFPIWALGEYRCRVLQAP

SEQ ID NO: 52 - protein, 785 aa, Cucumis sativus
MWRLKVGKESVGEKEEKWIKSISNHLGRQVWEFCAENDDDDDDEAVIHVVANSSKHLLQQQRRQSSFENARKQFRNNRFHRKQSSDLFLTIQYEKEIARNGAKNGGNTKVKEGEDVKKEAVNNTLERALSFYSAIQTGDGNWASDLGGPMFLLPGLVIALYVTGVLNSVLSKHHRQEMCRYIYNHQNEDGGWGLHIEGSSTMFGSALNYVALRLLGEDANGGECGAMTKARSWILERGGATAITSWGKLWLSVLGVYEWSGNNPLPPEFWLLPYSLPFHPGRMWCHCRMVYLPMSYLYGKRFVGPITPMVLSLRKELYTIPYHEVDWNRSRNTCAQEDLYYPHPKMQDILWGSIYHVYEPLFNGWPGRRLREKAMKIAMEHIHYEDENSRYICLGPVNKVLNMLCCWVEDPYSDAFKFHLQRIPDYLWLAEDGMRMQGYNGSQLWDTAFSIQAILSTKLIDTFGSTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAALAKAANFLENMQRTDGSWYGCWGVCFTYAGWFGIKGLVAAGRTYNNCVAIRKACHFLLSKELPGGGWGESYLSCQNKVYTNLEGNRPHLVNTAWVLMALIEAGQGERDPAPLHRAARLLINSQLENGDFPQQEIMGVFNKNCMITYAAYRNIFPIWALGEYSHRVLTE

SEQ ID NO: 53 - protein, 764 aa, Cucurbita foetidissima
MWRLKVGAESVGEKDEKWVKSVSNHLGRQVWEFCADADAVTPHQSLQIHNARNHFHQNRFRRKQSSDLFLAIQYEKEIAKGVKVGAVKVKEGEEVGKEAVKSTLERALSFYSAVQTSDGNWASDLGGPMFLLPGLVIALYVTGVLNSVLSKHHRLEMCRYLYNHQNEDGGWGLHIEGTSTMFGSALNYVALRLLGEDADGGDGGAMTKARAWILERGGATAITSWGKLWLSVLGVYEWSGNNPLPPEFWLLPYSLPFHPGRMWCHCRMVYLPMSYLYGKRFVGPITPKVLSLRQELYTVPYHEIDWNKSRNTCAKEDLYYPHPKMQDILWGSIYHVYEPLFTRWPGKRLREKALQTAMKHIHYEDENSRYICLGPVNKVLNMLCCWVEDPYSDAFKLHLQRVHDYLWVAEDGMRMQGYNGSQLWDTAFSIQAIVATKLVDSYGPTLRKAHDFVKDSQIQEDCPGDPNVWFRHIHKGAWPFSTRDHGWLISDCTAEGLKASLMLSKLPSTMVGEPLEKSRLCDAVNVLLSLQNDNGGFASYELTRSYPWLELINPAETFGDIVIDYPYVECTAATMEALTLFKKLHPGHRTKEIDTAIAKAANFLEKMQRTDGSWYGCWGVCFTYAGWFGIKGLVAAGRTYNSCVAIRKACEFLLSKELPGGGWGESYLSCQNKVYTNLEGNKPHLVNTAWVLMALIEAGQGERDPAPLHRAARLLMNSQLENGDFLQQEIMGVFNKNCMITYAAYRNIFPIWALGEYCHRVLTE

SEQ ID NO: 54 - protein, 765 aa, Cucumis melo
MWQLKVGADTVPSDPSNAGRWLSTLNNHVGRQVWHFHPELGSPEDLQQIQNARQHFYDHRFEKKHSSDILMRMQFAKENSSFVNLPQIKVKEKEDVVEEAVTQTLRRAMNFYSTIQADDGHWPGDYGGPMFLLPGLVITLSITGALNAVLSTEHQREICRYLYNHQNRDGGWGLHIEGPSTMFGSVLSYVTLRLLGEEAEDGQGGVENARKWILDHGGATAITSWGKMWLSVLGVYEWAGNNPLPPELWLLPYLLPFHPGRMWCHCRMVYLPMCYLYGKRFVGPITPIIRSLRKELYLVPYHEIDWNEARNQCAKEDLYYPHPLVQDVLWASLHHVYEPLFMRWPAKRLREKALRTVMQHIHYEDENTRYICIGPVNKVLNMLCCWVEDPHSEAFKLHIPRIYDYLWLAEDGMKMQGYNGSQLWDTAFAVQAIMSTKLVEEYGTTLRKAHKYIKDSQVLEDCPGDLQSWYRHISKGAWPFSTADHGWPISDCTAEGLKAVVLLSKLPSEIVGKPVDEERMYDAVNVILSLQNTDGGFATYELTRSYRWLELMNPAETFGDIVIDYPYVECTSAAIQALAAFRKLYPGHRSNEIGNCIAKAADFIESIQATDGSWYGSWGVCFTYGGWFGIKGLVAAGRRYENSSSLRKACDYLLSKELPAGGWGESYLSCQDKVYTNIKDDRPHLVNTAWAMLSLIDAGQAERDPTPLHRAARILINSQMEDGDFPQEDIMGVFNKNCMISYSAYRNIFPIWALGAYRCRVLLAS

SEQ ID NO: 55 - protein, 765 aa, Cucumis metuliferus
MGEMWKLKFSKGWETSENDHVGRQYWEFDTNLTPSEEEKAQIQKFYNEFYNYRFQAKHSSDLLMRFQLRKENNGGEVKLPTQIKITGEEEINEEAIEKTLRRGIRFYSTLQTQDGFWPGDYGGPLFLLPALVIGLSVTKALDTAISVHHRHEMCRYLYNHQNEDGGWGLHIEGNSTMLCTALSYVSLRLLGEKMDGRDGVLLKARRWILDRGGATSIPSWGKTWLSVLGVYEWEGNNPLPPEIWLLPYSLPLHPGRMWCHSRMVYLPMSYLYGKRFVGPISPIIISLRRELYTCSYHTIDWNLSRNLCAKEDLYTPHSKIQNILWNSIHKFGEPLLKKWPLSKVRQKALDFVIQHIHYEDENTHYLCLGPISKVLNMVCCWAEDPNSEAFRRHIPRIKDYLWLAEDGMKMQGYNGSQLWDVVFAVQAILATDLVDEYGSVLKKAHNFIKNSQMKRNGIKDQNNPSVWYRHMSKGGWPFSTPDNAWPVSDCTAEALKAAILLSQMPTTMVGEPIDVHNLYDAVNLILSLQNSNGGFASYELTRSYPWLEMLNPAEIFGDVMIDYQYVECTSAAIQGLKAFMKLHPGYRKKDIQTCISKAAHFIETIQLPDGSWYGSWGICYTYGTWFGIKGLVACGRTYANSKCIRKATQFLLSKQLKSGGWGESYLSAHHKVYADLKDGKSHIVNTSWALLALIQADQAQRDPSPLHRAATVLINSQMDDGDFPQQEIMGVFNKSCMISYAAYRNIFPIWALGEYRIRVLQLPEN

SEQ ID NO: 56 - protein, 766 aa, Artificial Sequence
  Synthetic Polypeptide
MWRLKIGADTVPSDPSNAGGWLSTLSNHLGRQVWEFCAELGSPEDLQQIQQARQRFSDHRFEKKHSADLLMRMQFAKENSSFVNLPQVKVKDKEEVSEEAVTRTLRRAINFYSTIQADDGNWASDLGGPMFLLPGLVIALYVTGVLNSVLSTEHQREICRYLYNHQNRDGGWGLHIEGPSTMFGSVLNYVTLRLLGEEAEDGQGAVDKARKWILDHGGAAAITSWGKMWLSVLGVYEWAGNNPLPPELWLLPYLLPCHPGRMWCHCRMVYLPMCYLYGKRFVGPITPIIRSLRKELYLVPYHEVDWNKARNQCAKEDLYYPHPLVQDILWASLHHVYEPLFMHWPAKRLREKALQSVMQHIHYEDENSRYICLGPVNKVLNMLCCWAEDPHSEAFKLHIPRIYDYLWIAEDGMRMQGYNGSQLWDTAFSVQAIISTELAEEYETTLRKAHKYIKDSQVLEDCPGDPNVWFRHIHKGAWPFSTRDHGWLISDCTAEGLKASLMLSKLPSKIVGEPLEKQQLYNAVNVLLSLQNENGGFASYELTRSYPWLELINPAETFGDIVIDYPYVECSSAAIQALAAFKKLYPGHRRDEINNCIAKAADFIESIQATDGSWYGSWGVCFTYAGWFGIKGLVAAGRTYNNCSSLRKACDFLLSKELAAGGWGESYLSCQNKVYTNIKDDRPHIVNTGWAMLSLIDAGQSERDPTPLHRAARVLINSQMEDGDFPQEEIMGVFNKNCMITYAAYRNIFPIWALGEYRSRVLKLLK

SEQ ID NO: 57 - protein, 762 aa, Cucurbita pepo
MWRLKIADGGNDPYIYSTNDFIGRQTWEFDPEAGTPEERQEVEEARHHFYRNRYKVKPSADCLWRMQFLREKKFKQEIGAVKIKEGEEISQDKARIALRRAVHFYSALQASDGHWPAENAGPLFFLPPLVMCLYITGHLDQVFPEEHKKEILRYIYCHQNEDGGWGLHIEGHSTMFCTALSYICMRILGEGPDGGLNNACARGRKWILDHGSVTYIPSWGKTWLSILGVYDWAGSNPMPPEFWLLPSFLPMHPAKMWCYCRMVYMPMSYLYGKRFVCQITPLIQELRLELHAQPFDEINWKKTRHLCTKEDVYYPHPLMQDLLWDSLYICTEPLLTRWPFNKLVREKALQVTMKHIHYEDDNSRYITIGCVEKVLCMLACWVEDPDGDYFKKHLARIPDYIWVAEDGMKMQSFGSQEWDTGFAIQALLAADMADEIGPVLARGHDFIKKSQVKDNPSGNFKTMHRHISKGSWTFSDQDHGWQVSDCTAEALKCCLLFSLMRPEIVGDKMEAQRLYDSVNVLLSLQSKNGGLAAWEPATGQKWLEMLNPTEFFADIVIEHEYVECTASAIQALILFKKLHPGHRTKEIDNFIQNAVRYLQDIQMPDGSWYGNWGVCFTYGCWFALGGLVAAAKTFNNCAAIRKGVHFLLNIQMPDGGWGESYHCCPSKKYVPLEGKRSNLVHTAWAMMALIHSGQAERDPTPLHRAAKLLINSQTEDGDFPQQEITGVFMKNCMLHYAAYRNIYPLWALAEYSKRVKLASTSP

SEQ ID NO: 58 - protein, 762 aa, Cucurbita pepo
MWRLKVADGGNDPYIYSMNNFVGRQIWEFDPDAGSPDERAEVERVRNEFTKNRLKGFPSADLLWRLQLLREKNFKQSIPPVKVEDGEEITYEMASDAMKRGAYFLEAIQASDGHWPSETSGPLFYLCPLLICMYIMGFMDSAFSPEHKKEMMRYLYNHQNEDGGWGLHVGGHSNMFCTTFNYISLRLLGEEPDVEAVAKGRIWIRDHGGVTSILSWGKTWLSILNLFDWSASNPMPPEYWMFPTWVPIHPSNMMCYTRITYMPMSYLYGKRFQAPLTPLVLQLRDELHTQAYEKINWRKVRHMCATEDLYFPHPFVQDLLWDTLYMLSEPLMTRWPFNKLIRQKALDETMRHIHYEDENSRYITIGCVEKPLCMLACWVEDPNSEYVKKHFARIPDYLWMAEDGMKMQSFGSQSWDAALAMQALLACNITHDIGSALNNGHEFIKNSQVRNNPPGDYKSMFRYMSKGSWTFSDCDHGWQVSDCTAENLKCCLLLSLLPPEIVGEKMEPQRFYDAVNVILNMQSKNGGLPAWEPASSYYWMEWLNPVEFLEDLIIEHQHVECTSSALQAILLFRKQYPEHRKKEINNFINKAVQFLQDIQLPDGSWYGNWGICYTYGTWFALKALSMAGKTYENCEALRKGANFLIKIQNPEGGFGESYLSCPYKRYIPLDGKRSNLVQTAWGMMGLIAAGQADVDPGPIHRAAKLLINSQTEDGDFPQEEITGEFFKNCTLHFAAFREVFPVMALGEYCNKVPLPSKKNTIN

SEQ ID NO: 59 - protein, 759 aa, Artificial Sequence
  Synthetic Polypeptide
MWRLKVADGGNDPYIYSMSNHLGRQVWEFCADAGSPDERAEVERVRNEFTKNRLKGFPSADLLWRLQLLREKNFKQSIPPVKVEDGEEITYEMASDAMKRGAYFLEAIQASDGNWASDLGGPMFLLPGLVIALYVTGVLNSAFSPEHKKEMMRYLYNHQNEDGGWGLHVGGHSNMFCTTFNYISLRLLGEEPDVEAVAKGRIWIRDHGGVTSILSWGKTWLSILNLFDWSASNPMPPEYWMFPTWVPIHPSNMMCYTRITYMPMSYLYGKRFQAPLTPLVLQLRDELHTQAYEKINWRKVRHMCATEDLYFPHPFVQDLLWDTLYMLSEPLMTRWPFNKLIRQKALDETMRHIHYEDENSRYICLGPVEKPLCMLACWVEDPNSEYVKKHFARIPDYLWMAEDGMRMQGYNGSQLWDTAFSQALLACNITHDIGSALNNGHEFIKNSQVRNNPPGDPNVWFRHIHKGAWPFSTRDHGWLISDCTAEGLKASLMLSKLPSKIVGEPLEKYDAVNVLLSLQNENGGFASYELTRSYPWLELINPAETFGDIVIDYQHVECTSSALQAILLFRKQYPEHRKKEINNFINKAVQFLQDIQLPDGSWYGNWGICYTYAGWFGIKGLVAAGRTYNNCEALRKGANFLIKIQNPEGGFGESYLSCPYKRYIPLDGKRSNLVQTAWGMMGLIAAGQADVDPGPIHRAAKLLINSQTEDGDFPQEEIMGVFNKNCMITYAAFREVFPVMALGEYCNKVPLPSKKNTIN

SEQ ID NO: 60 - protein, 785 aa, Cucumis sativus
MWRLKVGKESVGEKEEKWIKSISNHLGRQVWEFCAENDDDDDDEAVIHVVANSSKHLLQQQRRQSSFENARKQFRNNRFHRKQSSDLFLTIQYEKEIARNGAKNGGNTKVKEGEDVKKEAVNNTLERALSFYSAIQTSDGNWASDLGGPMFLLPGLVIALYVTGVLNSVLSKHHRQEMCRYIYNHQNEDGGWGLHIEGSSTMFGSALNYVALRLLGEDANGGECGAMTKARSWILERGGATAITSWGKLWLSVLGVYEWSGNNPLPPEFWLLPYSLPFHPGRMWCHCRMVYLPMSYLYGKRFVGPITHMVLSLRKELYTIPYHEIDWNRSRNTCAQEDLYYPHPKMQDILWGSIYHVYEPLFNGWPGRRLREKAMKIAMEHIHYEDENSRYICLGPVNKVLNMLCCWVEDPYSDAFKFHLQRIPDYLWLAEDGMRMQGYNGSQLWDTAFSIQAILSTKLIDTFGSTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAALAKAANFLENMQRTDGSWYGCWGVCFTYAGWFGIKGLVAAGRTYNNCVAIRKACHFLLSKELPGGGWGESYLSCQNKVYTNLEGNRPHLVNTAWVLMALIEAGQGERDPAPLHRAARLLINSQLENGDFPQQEIMGVFNKNCMITYAAYRNIFPIWALGEYSHRVLTE

SEQ ID NO: 61 - protein, 758 aa, Vitis vinifera
MWRLKVADGGNDPYIDSTNNFVGRQIWEFDPDYGTPDERAEVEAARENFWKNRFQVKLSSDLLWRMQFARENPCVTNLPQIKVQDLEEVTEEVVTTTLRRGLNFYSTIQAHDGHWPGDCGGPMFLLPGLVITLYVTGALHVVLSIEQQREMCRYLCNHQNEDGGWGLHIEGPSTMFGTVLNYVTLRLLGEADFGAKGAMEKGQKWILDHGGATAITSWGKMWLSVLGAYEWFGTNPLPPEMWLCPYILPVHPGRMWCHCRMVYLPMSYLYGKKFVGPITSTIISLRKELYIVPYHEVDWNQARNQCAKEDLYYPHPLVQDILWASLHKVLEPILGHWPGNNLREKALCTVMQHVHYEDENTRYICLGPVNKVLNMLCCWIEDPNSEAFKLHIPRIFDYLWIAEDGMKMQGYSGSQLWDTSFAVQAIISTNLGEEYGLTLRKAHEFIKNSQVLEDCPGDLKFWYRHISKGAWPFSTADQGWPISDCTAEGLKAVLLLSKLPVETVGEPLDMKHLSDAVNVILSLQNADGGFATYELTRSYRWVELINPAETFGDIVIDYPYVECTSAAIQALTSFKKLYPEHRRHEIENCISKAAKFIEEIQAPDGSWYGCWGVCFTYGGWFGITGLIAAGNTYSNCPCIRKACDYLLSKELASGGWGESYLSCQNKVYTNLPGDKPHIVNTAWAMLALIEAGQAGRDPNPLHRAARILINSQMKNGDFPQEEIMGVFNKNCMINYSAYRNIFPIWALGEHRSRVLHSS

SEQ ID NO: 62 - protein, 786 aa, Gynostemma cardiospermum
MGNIKERKGKDRERQREMWKLKIGGESVGKNNEEKWLKSISNHLGRQVWEFCPKLETETETETESQIENARNTFHLNRFHKKQSSDLFITLQYGNEIAKIEGVKIKEKEEVREEAVKTTLERALNFYSAIQTSDGHWASDLGGPMFLLPGLVITLYVTGVLNSVLSKHHRQEICRYLYNHQNEDGGWGLHIEGPSTMFGSVLNYVALRLLAQDSEYDSILKGRRWILDHGGATGITSWGKLWLSVLGVYEWCGNNPLPPEFWILPYFLPFHPGRMWCHCRMVYLPMSYLYGKRFVGPITPTVLSLRKELYTVPYHEIDWNKSRNTCAKEDLYYPHPKIQDILWASLHHVYEPFFTRWPGKRLRDKALHAAMQHIHYEDENTRYICLGPVNKVLNMLCCWVEDPHSDAFKFHLQRVYDYLWVAEDGMKMQGYNGSQLWDTAFSVQAIISTKLTENFGPTLRKAHNFIKLSQIQQDCPGDPNIWYRHIHKGAWPFSTADHGWLISDCTAEGLKASLLLSKVSSNTVGEPLERNRLFDAVNVLLSLQNKNGGIASYELTRSYPWLELINPAETFGDIVIDYPYVECTSATIEALALFKKLYPGHRTKEIDNVIAKAAKFLEDMQREDGSWYGCWGVCFTYAGWFGIKGLVAAGRQYNNSPTIRKACNFILSKELPGGVGGWGESYLSCQNKVYTNLDGNRPHLVNTSWALMALIEAGQADRDPTPLHRAARLLINSQLENGDFPQQEIMGVFNKNCMITYAAYRNIFPIWALGEYCHRVLNQHRSSPLF

SEQ ID NO: 63 - protein, 769 aa, Gynostemma cardiospermum
MWKLKIGGESVGKNNEEKWLKSISNHLGRQVWEFCPKLETETETETESQIENARNTFHLNRFHKKQSSDLFITLQYGNEIAKIEGVKIKEKEEVREEAVKTTLERALNFYSAIQTSDGHWASDLGGPMFLLPGLVITLYVTGVLNSVLSKHHRQEICRYLYNHQNEDGGWGLHIEGPSTMFGSVLNYVALRLLAQDSEYDSILKGRRWILDHGGATGITSWGKLWLSVLGVYEWCGNNPLPPEFWILPYFLPFHPGRMWCHCRMVYLPMSYLYGKRFVGPITPTVLSLRKELYTVPYHEIDWNKSRNTCAKEDLYYPHPKIQDILWASLHHVYEPFFTRWPGKRLRDKALHAAMQHIHYEDENTRYICLGPVNKVLNMLCCWVEDPHSDAFKFHLQRVYDYLWVAEDGMKMQGYNGSQLWDTAFSVQAIISTKLTENFGPTLRKAHNFIKLSQIQQDCPGDPNIWYRHIHKGAWPFSTADHGWLISDCTAEGLKASLLLSKVSSNTVGEPLERNRLFDAVNVLLSLQNKNGGIASYELTRSYPWLELINPAETFGDIVIDYPYVECTSATIEALALFKKLYPGHRTKEIDNVIAKAAKFLEDMQREDGSWYGCWGVCFTYAGWFGIKGLVAAGRQYNNSPTIRKACNFILSKELPGGVGGWGESYLSCQNKVYTNLDGNRPHLVNTSWALMALIEAGQADRDPTPLHRAARLLINSQLENGDFPQQEIMGVFNKNCMITYAAYRNIFPIWALGEYCHRVLNQHRSSPLF

SEQ ID NO: 64 - protein, 759 aa, Siraitia grosvenorii
MWRLKVGAESVGENDEKWLKSISNHLGRQVWEFCPDAGTQQQLLQVHKARKAFHDDRFHRKQSSDLFITIQYGKEVENGGKTAGVKLKEGEEVRKEAVESSLERALSFYSSIQTSDGNWASDLGGPMFLLPGLVIALYVTGVLNSVLSKHHRQEMCRYVYNHQNEDGGWGLHIEGPSTMFGSALNYVALRLLGEDANAGAMPKARAWILDHGGATGITSWGKLWLSVLGVYEWSGNNPLPPEFWLFPYFLPFHPGRMWCHCRMVYLPMSYLYGKRFVGPITPIVLSLRKELYAVPYHEIDWNKSRNTCAKEDLYYPHPKMQDILWGSLHHVYEPLFTRWPAKRLREKALQTAMQHIHYEDENTRYICLGPVNKVLNLLCCWVEDPYSDAFKLHLQRVHDYLWVAEDGMKMQGYNGSQLWDTAFSIQAIVSTKLVDNYGPTLRKAHDFVKSSQIQQDCPGDPNVWYRHIHKGAWPFSTRDHGWLISDCTAEGLKAALMLSKLPSETVGESLERNRLCDAVNVLLSLQNDNGGFASYELTRSYPWLELINPAETFGDIVIDYPYVECTSATMEALTLFKKLHPGHRTKEIDTAIVRAANFLENMQRTDGSWYGCWGVCFTYAGWFGIKGLVAAGRTYNNCLAIRKACDFLLSKELPGGGWGESYLSCQNKVYTNLEGNRPHLVNTAWVLMALIEAGQAERDPTPLHRAARLLINSQLENGDFPQQEIMGVFNKNCMITYAAYRNIFPIWALGEYCHRVLTE

SEQ ID NO: 65 - protein, 765 aa, Artificial Sequence
  Synthetic Polypeptide
MWRLKVGADTVPADPSNAGGWLSTLSNHLGRQVWEFCAELGSPEDLQQIQHARQRFSDHRFEKKHSADLLMRMQFAKENSSFVNLPQIKVKDKEDVIEEAVTRTLRRAINFYSTIQADDGNWASDLGGPMFLLPGLVIALYVTGVLNSVLSTEHQREICRYLYNHQNRDGGWGLHIEGPSTMFGSVLNYVTLRLLGEEAEDGQGGVDKARKWILDHGGATAITSWGKMWLSVLGIYEWAGNNPLPPELWLLPYLLPCHPGRMWCHCRMVYLPMCYLYGKRFVGPITPIIRSLRKELYLVPYHEVDWNEARNQCAKEDLYYPHPLVQDVLWASLHHVYEPLFMRWPAKRLREKALRSVMQHIHYEDENSRYICLGPVNKVLNMLCCWAEDPHSEAFKLHIPRIYDYLWIAEDGMRMQGYNGSQLWDTAFSVQAIISTKLAEEYGTTLRKAHKYIKDSQVLEDCPGDPNVWFRHIHKGAWPFSTRDHGWLISDCTAEGLKASLMLSKLPSKIVGEPLEKERIYDAVNVLLSLQNENGGFASYELTRSYPWLELINPAETFGDIVIDYPYVECTSAAIQALAAFKKLYPGHRSNEIGNCIAKAADFIESIQATDGSWYGSWGVCFTYAGWFGIKGLVAAGRTYNNCSSLRKACDFLLSKELAAGGWGESYLSCQDKVYTNIKDDRPHIVNTGWATLSLIDAGQAERDPTPLHRAARVLINSQMDDGDFPQEEIMGVFNKNCMITYAAYRNIFPIWALGEYRCRVLQAP

SEQ ID NO: 66 - protein, 758 aa, Artificial Sequence
  Synthetic Polypeptide
MWRLKIAEGGNPWLRTTNDHVGRQVWEFDPELGSPEELSAIELARRDFTKNRFEHKHSADLLMRIQFSKENPLERVLPQVKLKEKEDVTKEAVKSTLERALSFYSAVQTSDGNWASDLGGPMFLLPGLVIALSVTGAMNAVLSEQHKSEMRRYLYNHQNEDGGWGLHIEGPSTMFGSVLSYVTLRLLGEGANDGEGAMEKGRDWIVNHGGATAITSWGKMWLSVLGVFEWSGNNPLPPEIWLLPYMLPIHPGRMWCHCRMVYLPMSYLYGKRFVGPITPTVLSLRKELFSTPYHEIDWNRARNECAKEDLYYPHPLIQDLLWGSLHNFVEPILMAWPGKKLREKALRTTLEHIHYEDENTRYICLGPVNKVLNLLCCWVEDPYSDAFKLHLQRVHDYLWVAEDGMKMQGYNGSQLWDTAFSIQAILSTNLIEEYASTLKKAHAFVKDSQIQEDCPGDPNVWFRHIHKGAWPFSTRDHGWLISDCTAEGLKASLMLSKLPSTMVGEPLEANRLCDAVNVLLSLQNDNGGFASYELTRSYPWLELINPAETFGDIVIDYPYVECTSATMEALTLFKKLHPGHRTKEIDTCIKKAVAFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQAERDPAPLHRAARFLINSQMENGDFPQQEIMGVFNRNCMITYSAYRDIFPIWALGEYRTKVLHASS

SEQ ID NO: 67 - protein, 759 aa, Artificial Sequence
  Synthetic Polypeptide
MWRLKISEGGNPWLRTTNNHVGRQVWEFDPELGSPEELSAIELARRDFTKNRFEQKHSADLLMRIQFSKENPLERVLPQVKLREKEDVTKEAVKSTLERALSFYSAVQTSDGNWASDLGGPMFLLPGLVIALSVTGAMNAVLSEQHKSEMCRYLYNHQNEDGGWGLHIEGPSTMFGSVLSYVTLRLLGEGPNDGEGAMGKGRDWILNHGGATAITSWGKLWLSVLGVFEWSGNNPLPPEIWLLPYMLPIHPGRMWCHCRMVYLPMSYLYGKRFVGPITPTVLSLRKELFSTPYHEIDWNRARNECAKEDLYYPHPLIQDLLWGSLHNFVEPILMAWPGKKLREKALRTTLEHIHYEDENTRYICLGPVNKVLNLLCCWVEDPYSDAFKLHLQRVHDYLWVAEDGMKMQGYNGSQLWDTAFSIQAILSTNLVEEYASTLKKAHTYVKDSQIQEDCPGDPNVWFRHIHKGAWPFSTRDHGWLISDCTAEGLKASLMLSKLPSTMVGEPLEANRLCDAVNVLLSLQNDNGGFASYELTRSYPWLELINPAETFGDIVIDYPYVECTSATMEALTLFKKLHPGHRTKEIDTCIKKAVAFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQAERDPAPLHRAARFLINSQMENGDFPQQDIMGVFNRNCMITYAAYRDIFPIWALGEYRTKVLHASPS

SEQ ID NO: 68 - protein, 762 aa, Momordica charantia
MWRLKVGAESVGENDEKWVKSISNHLGRQVWEFCPDAGTPQQLLQIEKARKAFQDNRFHRKQTSDLLVSIQCEKGTTNGARVPGTKLKEGEEVRKEAVKSTLERALSFYSSIQTSDGNWASDLGGPMFLLPGLVIALCVTGALNSVLSKHHRQEMCRYLYNHQNEDGGWGLHIESPSTMFGSALNYVALRLLGEDADGGEGRAMTKARAWILGHGGATAITSWGKLWLSVLGVYEWSGNNPLPPEFWLLPYFLPFHPGRMWCHCRMVYLPMSYLYGKRFVGPITPVVLSLRKELYTVPYHEIDWNKSRNTCAKEDLYYPHSKMQDILWGSIHHMYEPLFTHWPAKRLREKALKTAMQHIHYEDENTRYICLGPVNKVLNMLCCWVEDPYSEAFKLHLQRVHDYLWVAEDGMKMQGYNGSQLWDTAFSVQAIISTKLVDNYGPTLRKAHDYVKNSQIQQDCPGEPNVWFRHIHKGAWPFSTRDHGWLISDCTAEGLKASLMLSKLPSETVGEPLERNRLCDAVNVLLSLQNDNGGFASYELTRSYPWLELINPAETFGDIVIDYPYVECTSATMEALALFKKLHPGHRTKEIDTAIARAADFLENMQRTDGSWYGCWGVCFTYAGWFGIKGLVAAGRAYSNCLAIRKACDFLLSKELPGGGWGESYLSCQNKVYTNLEGNRPHLVNTAWVLMALIEAGQGERDPAPLHRAARLLINSQLENGDFPQEEIMGVFNKNCMITYAAYRNIFPIWALGEYCHRVLTE

SEQ ID NO: 69 - protein, 703 aa, Momordica charantia
MGSNNFVGRKMWRLKLGEGANNPYLWSSNNFVGRQTWDFEADEGTPEERAQIEAARKTYFQNRFKVQCSNDLFWKFQVFAFYITGHLGTIFPEEHQKELLRYAYCHQNEDGGWGLYIMGESCMLCTVLNYIQLRLLGEEPDTDACNRARKWILDHGGALYIPSWGKIWLSILGVYEWDGANPMPPEFWLFGNALPLKPGHLLGYSRLTLLPMSYLYGKRFVGTLTPLILQLRQEIYTQPYSNIKWSPARHYCAKEDKCFERSWIQKLAWDAVHYLGEPLLGSWAFKSVRNRALQIARFHIDYEDQNSHYITIGCVEKPLCTLATWVDDPNGQAYKKHLARVKDYLWIGEDGMKIQSFGSQSWDVAFAIQAILATNFHREFSDTLKKGHDFIKKSQIRENPSGDFQSMYRHISKGSWSFSDQDHGWQLSDCTAENLTCCLILSTMPPDMVGDPMKPQCFFDAVNIILSLQAKNGGVSAWEPTGIVSSWFERLNPVEFLEYSILELEYVECTSSSLQALVLFKKLFPNHRKKEIETFITKGVNYIKEMQKDDGSWYGNWGICHLYATYFAIKGLVAVGYSYDSCSTIRRGVDFLLKIQCPDGGWGESHVSVTKKVYTPLQHNASNLVQTSFALMALIHAQQANRDPTPVHRAAKLLINSQLEDGDYPQQEITGAFMGNCMLHYPLYKNVFPLWALADYCNLVPLP

SEQ ID NO: 70 - protein, 756 aa, Artificial Sequence
  Synthetic Polypeptide
MWKLKVAEGGTPWLRTLNNHVGRQVWEFDPHSGSPQDLDDIETARRNFHDNRFTHKHSDDLLMRLQFAKENPMNEVLPKVKVKDVEDVTEEAVATTLRRGLNFYSTIQSHDGHWPGDLGGPMFLMPGLVITLSVTGALNAVLTDEHRKEMRRYLYNHQNKDGGWGLHIEGPSTMFGSVLCYVTLRLLGEGPNDGEGDMERGRDWILEHGGATYITSWGKMWLSVLGVFEWSGNNPMPPEIWLLPYALPVHPGRMWCHCRMVYLPMSYLYGKRFVGPITPTVLSLRKELFTVPYHDIDWNQARNLCAKEDLYYPHPLVQDILWATLHKFVEPVFMNWPGKKLREKAIKTAIEHIHYEDENTRYICIGPVNKVLNMLCCWVEDPNSEAFKLHLPRIYDYLWVAEDGMKMQGYNGSQLWDTAFAAQAIISTNLIDEFGPTLKKAHAFIKNSQVSEDCPGDLSKWYRHISKGAWPFSTADHGWPISDCTAEGLKAVLLLSKIAPEIVGEPLDSKRLYDAVNVILSLQNENGGLATYELTRSYTWLEIINPAETFGDIVIDCPYVECTSAAIQALATFGKLYPGHRREEIQCCIEKAVAFIEKIQASDGSWYGSWGVCFTYATWFGIKGLIAAGKNFSNCLSIRKACEFLLSKQLPSGGWAESYLSCQNKVYSNLEGNRSHVVNTGWAMLALIEAEQAKRDPTPLHRAAVCLINSQLENGDFPQEEIMGVFNKNCMITYAAYRCIFPIWALGEYRRVLQAC

SEQ ID NO: 71 - protein, 764 aa, Cucurbita pepo
MWRLKVGAESVGEEDEKWVKSVSNHLGRQVWEFCADAAADTPHQLLQIQNARNHFHHNRFHRKQSSDLFLAIQYEKEIAKGAKGGAVKVKEGEEVGKEAVKSTLERALGFYSAVQTRDGNWASDLGGPLFLLPGLVIALHVTGVLNSVLSKHHRVEMCRYLYNHQNEDGGWGLHIEGTSTMFGSALNYVALRLLGEDADGGDGGAMTKARAWILERGGATAITSWGKLWLSVLGVYEWSGNNPLPPEFWLLPYSLPFHPGRMWCHCRMVYLPMSYLYGKRFVGPITPKVLSLRQELYTIPYHEIDWNKSRNTCAKEDLYYPHPKMQDILWGSIYHVYEPLFTRWPGKRLREKALQAAMKHIHYEDENSRYICLGPVNKVLNMLCCWVEDPYSDAFKLHLQRVHDYLWVAEDGMRMQGYNGSQLWDTAFSIQAIVATKLVDSYAPTLRKAHDFVKDSQIQEDCPGDPNVWFRHIHKGAWPLSTRDHGWLISDCTAEGLKASLMLSKLPSTMVGEPLEKNRLCDAVNVLLSLQNDNGGFASYELTRSYPWLELINPAETFGDIVIDYPYVECTAATMEALTLFKKLHPGHRTKEIDTAIGKAANFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQGERDPAPLHRAARLLMNSQLENGDFVQQEIMGVFNKNCMITYAAYRNIFPIWALGEYCHRVLTE

SEQ ID NO: 72 - protein, 764 aa, Sechium edule
MWRLKVGAESVGEKDEKWVKSVSNHLGRQVWEFCADADAVTPHQSLQIHNARNHFHQNRFRRKQSSDLFLAIQYEKEIAKGVKVGAVKVKEGEEVGKEAVKSTLERALSFYSAVQTSDGNWASDLGGPMFLLPGLVIALYVTGVLNSVLSKHHRLEMCRYLYNHQNEDGGWGLHIEGSSTMFGSALNYVALRLLGEDVDGGDGGAMTKGRAWILDRGSATAITSWGKLWLSVLGVYEWSGNNPLPPEFWLLPYSLPFHPGRMWCHCRMVYLPMSYLYGKRFVGPITPIVLSLRKELYTVPYHEIDWNKSRNTCAKEDLYYPHPKVQDILWGTIHHVYEPLFSGWPCKRLREKALQTAMKHIHYEDENSNYICLGPVNKVLNMLCCWVEDPYSDAFKLHLQRIHDFLWVSEDGMKMQGYNGSQLWDTAFSIQAIASTKLVDTYGHSLRKAHNFVKNSQIQQDCPGDSNVWFRHIHKGAWPFSTRDHGWLISDCTAEGLKASLTLSKLPSQLVGEPLEKNRLYDAVNVLLSLQNENGGFASYELTRSYPWLELINPAETFGDIVIDYSYVECTAATMEALALFKKLHPGHRTKEIDTCIAKAANFLETMQRTDGSWYGCWGVCFTYAGWFGIKGLIAAGRTYKTCIAIRKACDFLLSKELPGGGWGESYLSCQNKVYTNLEGNRPHLVNTAWVLMALIEAGQAKRDQAPLHRAARLLINSQLENGDFPQQEIMGVFNKNCMITYAAYRNIFPIWALGEYYHRVLTK

SEQ ID NO: 73 - protein, 759 aa, Siraitia grosvenorii; identical to SEQ ID NO: 64

SEQ ID NO: 74 - protein, 759 aa, Siraitia grosvenorii; identical to SEQ ID NO: 64

SEQ ID NO: 75 - protein, 763 aa, Trichosanthes kirilowii
MWRLKVGGESVGEKEEKWVKSISNHLGRQVWEFCPHDGTPEQRLQVQKARDAFFRINRFRRKQSSDLFLAIQYEKEIANGATVGGIKLKEGDEVRKEAVKSTLERALNFYSAVQTTDGNWASDLGGPMFLLPGLVIALYVTGVLNSVLSKNHRQEMCRYLYNHQNEDGGWGLHIEGPSTMFGSALNYVALRLLGEDADGGDGGAMTKARAWILDRGGATAITSWGKLWLSVLGVYEWSGNNPLPPEFWLLPYFLPFHPGRMWCHCRMVYLPMSYLYGKRFVGPITPIVLSLRKELYTVPYHEVDWNKSRNTCAKEDLYYPHPKMQDILWGSIHHVYEPLFSRWPGKRLREKALQSAMQHIHYEDENTRYICLGPVNKVLNMLCCWVEDPYSDAFKLHLQRVHDYLWVSEDGMKMQGYNGSQLWDTAFSIQAIASTKLVDSYGPTLRKAHDFVKNSQIQQDCPGDSNVWFRHIHKGAWPFSTRDHGWLISDCTAEGLKASLMLSKLPSEIVGPSLEKNRLCDAVNVLLSLQNDNGGFASYELTRSYPWLELINPAETFGDIVIDYSYVECTSATMEALTLFKKLHPGHRTKEIDTAIGKAANFLEKMQRTDGSWYGCWGVCFTYAGWFGIKGLVAAGRTYNSCIAIRKACDFLLSKELPGGGWGESYLSCQNKVYTNLEGNRPHLVNTAWVLMALIEAGQAERDPAPLHRAARLLINSQLENGDFPQEEIMGVFNKNCMITYAAYRNIFPIWALGEYCHRVLTE

SEQ ID NO: 76 - protein, 775 aa, Trichosanthes kirilowii
MGRRERWGGRREIMWRLKVGGESVGEKEEKWVKSISNHLGRQVWEFCPHDGTPEQRLQVQKARDAFRINRFRRKQSSDLFLAIQYEKEIANGATVGGIKLKEGDEVRKEAVKSTLERALNFYSAVQTTDGNWASDLGGPMFLLPGLVIALYVTGVLNSVLSKNHRQEMCRYLYNHQNEDGGWGLHIEGPSTMFGSALNYVALRLLGEDADGGDGGAMTKARAWILDRGGATAITSWGKLWLSVLGVYEWSGNNPLPPEFWLLPYFLPFHPGRMWCHCRMVYLPMSYLYGKRFVGPITPIVLSLRKELYTVPYHEVDWNKSRNTCAKEDLYYPHPKMQDILWGSIHHVYEPLFSRWPGKRLREKALQSAMQHIHYEDENTRYICLGPVNKVLNMLCCWVEDPYSDAFKLHLQRVHDYLWVSEDGMKMQGYNGSQLWDTAFSIQAIASTKLVDSYGPTLRKAHDFVKNSQIQQDCPGDSNVWFRHIHKGAWPFSTRDHGWLISDCTAEGLKASLMLSKLPSEIVGPSLEKNRLCDAVNVLLSLQNDNGGFASYELTRSYPWLELINPAETFGDIVIDYSYVECTSATMEALTLFKKLHPGHRTKEIDTAIGKAANFLEKMQRTDGSWYGCWGVCFTYAGWFGIKGLVAAGRTYNSCIAIRKACDFLLSKELPGGGWGESYLSCQNKVYTNLEGNRPHLVNTAWVLMALIEAGQAERDPAPLHRAARLLINSQLENGDFPQEEIMGVFNKNCMITYAAYRNIFPIWALGEYCHRVLTE

SEQ ID NO: 77 - protein, 757 aa, Solanum tuberosum
MWKLKVAEGGSPWLRTLNGHIGRQVWEFDPNLGSPKDLEEIEKFRAEFYKNRFETKHSSDLLMRYQFSKENPVGTILPRVQVKDIGDITEDNVATTLRRAISFYSTLQAHDGHWAADCGGPMFLLPGLVIALSVTGALNAVLSEEHKREICRYLYNHQNCDGGWGLHIESHSTMFGSVLSYVTLRLLGEKANGGEGAMEKGRKWILDHGTATAITSWGKMWLSVLGLFDWSGNNPLPPEMWLLPYILPFHPGRMWCHCRMVYLPMSYLYGKRFVGPITPTVLSLRKELFTVPYHKINWNKARNECAKEDLYYPHPLLQDILWTSLDKLIEPLFMHWPGKKLREKALSTVMDHIHYEDENTRYICLGPVNKVLNMLCCWVEDSSSEAFKLHLPRLYDYLWIAEDGMKIQGYNGSQSWDTSFAIQAIISTNLVEEYGPTLRKAHKFMKNSQVLDDCPGNLDFWYRHISKGAWPFSTADHGWPISDCTAEGLKACLLLSKLPVEIVGEPLKANRLYDAVNVMLSLQNPDGGIGTYELSRSYPWLEIINPAETFGDIVIDYPYVECTSAIIQALAAFKKLYPGYRKEDVERCIEKGAAFIEKIQEADGSWYGCWGVCFTYGTWFGVKGLLDAGRNFNNSYNIRKACDFLLSKQVVSGGWGESYLSCQNKVYTNLKGNKSHSVCTAWAMLALIEAGQGERDPTPLHRAAKVLINSQLENGDFPQQEISGVFNKNCMISYSAYRNIFPIWALGQYQSQLLNPQ

SEQ ID NO: 78 - protein, 768 aa, Zea mays
MWKLKVAAEGGGGPLLRSTNRFVGRTVWEFEPDLGTPEQRAEVEKARRDFSDHRFQRRHSADVLMRMQMQQYSKGTPLKLDLPAVKKLGEDEDVTEEAVSTSLKRAINRVSALQAHDGHWPGDCSGPLFLLPGLIITLYVTGALNAVLSSEHQREIRRYLYNHQNEDGGWGLHMEGHSAMLGTTLNYVALRLIGEGPDSGGDDGAAMERGRNWILQRGGATYTTSWGKFWLTVLGVYDWSGNNPLPPEMWLLPYHLPFHPGRMWCHCRAVYLPMSYVYGKRFVGRITPLVLELRNELYGDPYSLIDWNKARNQCAKEDLYYPHSFLQDVLWATLHKFVEPVMMHWPGIKFREIALRTAMRHIHYEDESTRYINLGPVNKVLNMLACWIEDPNSEAFKLHVPRIYDYLWLAEDGMKMKGYNGSQLWDAGLTVLAIVNTDLIEEFGPTLKLAHAFVKNSQIIDNCLEDLNQWYRHMSKGGWPFSTADHGWCVSDCTATGLEATLLLSTISPQIVGEAMEVGRVYDGVNCLISLMNNNGGFATFELTRSYAWLEHINPSETFGGIMIDYPYVECTSSSIQALALFKKLYPRHRTEEIDSCISKGANFIESMQRNDGSWYGSWGVCFTYATWFAVFGLACAGRTFEDSPAIKKACEFLLSKELPSGGWGESYLSCQDKVYTNLEGMRPHAVNTSWAMLALIRVGQAERDPAPLHRAARVLINLQSEDGEFPQQEIIGVFNQNCMIGYSQYRNIFPIWALGEYRTKVHVPRKK

SEQ ID NO: 79 - protein, 757 aa, Artificial Sequence
  Synthetic Polypeptide
MWRLKFAEGGSPWLRTTNNHVGRQVWEFDPRLGTPEELAEIEEARKSFAENRFVHKHSSDLLMRLQFSRENPVRQVLPQVEVKDTDDISKEAVKSTLERALSFYSAVQTSDGNWASDLGGPMFLLPGLVIALSITGALNAVLSEQHKQEMCRYLYNHQNEDGGWGLHIEGPSTMFGSVLNYVTMRLLGEGPNDGDGAMEKGRDWILNHGGATYITSWGKMWLTVLGVFEWSGNNPLPPEIWLLPYILPIHPGRMWCHCRMVYLPMSYLYGKRFVGPITPTVLSLRKELFTVPYHEVDWNKARNLCAKEDLYYPHPVVQDILWASLHKVVEPILMRWPVTKLREKALRTAIEHIHYEDENTRYICLGPVNKVLNLLCCWVEDPYSDAFKLHLQRVHDYLWVAEDGMKMQGYNGSQLWDTAFSIQAIFATNFVEEYGDVLKKANSYIKDSQIQEDCPGDPNVWFRHIHKGAWPFSTRDHGWLISDCTAEGLKASLMLSKLPSTMVGEPLEANRLCDAVNVLLSLQNDNGGFASYELTRSYPWLELINPAETFGDIVIDYPYVECTSATMEALTLFKKLHPGHRTKEIDQCIKKAAKFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQHERDPKPLHRAARYLINSQLENGDFPQQEIMGVFNKNCMITYAAYRNIFPIWALGEYRSQVLQAA

SEQ ID NO: 80 - protein, 663 aa, Artificial Sequence
  Synthetic Polypeptide
MDRQSFRDNRFHRKQSSDLFLAIQFAEEKQSVTNLPQTKLEEFEDVKKEAVKSTLERALSFYSAVQTSDGNWASDLGGPMFLLPGLVITLYVTGALNTVLSKEHQYEICRYLYNHQNRDGGWGLHIEGPSTMFGTVLNYVSLRLLGEGAEGGEGAIEKARRMWCHCRMVYLPMSFLYGKKFVGPITPTILSLRKELYTVPYHEVDWNKARNACAKEDLYYPHPLVQDILWASLHYLYEPMLKYWPCKSLREKALQIVMQHIHYEDENTRYICLGPVNKVLNMLCCWVEDPYSESFKLHLPRILDYLWIAEDGMKMQGYNGSQLWDTAFAIQAIISTGLADEYGSVLRKAHDFLKDSQIQEDCPGDPNVWFRHIHKGAWPFSTRDHGWLISDCTAEGLKASLMLSKLPSTMVGEPLEVNRLCDAVNVLLSLQNDNGGFASYELTRSYPWLELINPAETFGDIVIDYPYVECTSATMEALTLFKKLHPGHRTKEIDIGRAVEFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQAERDPTPLHRAAKILINSQMEDGDFPQEEIMGVFNKNCMISYSAYRNIFPIWALGEYHCRVLQAP

SEQ ID NO: 81 - DNA, 1401 bp, Artificial Sequence
  Synthetic Polynucleotide
atgctgctccagtccaacccgatggagaacgagacggagacgacggtgagccgccggcgcagaatattattatttcctgtaccatttcaaggtcatataaatccaatgttacaacttgcaaatgtcctttatagcaaaggattctccatcactattttccataccaatttcaacagtccaaagacctcaaattacccccactttacttttcgatttatcctagacaatgacccccaagataaaagaatttccaatctccccacacacggcccagcagcttcaatcaggattccatttttcaatgagtacagagccgatgaattaagacgtgagctagaattactcatgttggcttccgaagaagatggagaggtaagttgcctgattgcagatcagatatggtattttactcaatctgtcgcggatagcctcaatcttagaagattagtcttggttacatcctcattgttcaacttccacgcacatgtaagcctaccgcaattcgatgagttaggatatttggaccctgatgataaaactcggctagaagagcaagcttcaggatttcctatgctaaaagtaaaagatataaaatgtagcttttctatgtggaagaagtacaaggaatatttcgagaacattactaagcagacgaaagcgtcatccggcgtgatttggaatagctttaaagaattggaagagtctgagcttgaaaccgtaattcgggaaataccagccccttcttttcttattcctctaccaaaacacttaacggcatcttcgtcgtctttattagatcacgatcgtacagtgttcccgtggctggatcaacaacctagcaggtcggtcttatacgtatcatttggaagtggtactgaggtgttagatgaaaaagactttttagaaatagctagaggtttggttgactcaaagcaatcttttttgtgggtcgtcagacccggcttcgttaaaggttcaacgtgggtcgaacctctaccagatggtttcttgggtgaaagaggtagaattgttaagtgggtaccacaacaagaagtcctagctcatggagctataggtgcattttggactcactcaggctggaactcaacattggaatctgtgtgcgagggagtaccaatgatcttctctgatttcggtttagatcagcctctgaacgcaaggtacatgtcggatgtactaaaggtaggggtctatttggaaaatggatgggagagaggagagattgctaatgctatcagacgcgtaatggttgatgaggaaggtgaatatatcagacaaaatgccagagtgttaaagcaaaaagccgatgttagtttaatgaagggaggtagttcttacgagtcgttggagagtcttgtctcatacatatcttccttgtaa

SEQ ID NO: 82 - DNA, 1344 bp, Artificial Sequence
  Synthetic Polynucleotide
atggaggagcacgggggccgccggcggcccctggtcgtgctcacgtcgtgcccctttcatggacatatgattccaacattacaattagctacaacattacatgcaaaaggatttactattgctattgcacactctaagctcaatccgcctaacccgtccaatcatcctagcgattttatttttcttccactctcagatgacattcccgctatcgataattccggttctttcacagattttatacgaaaacttaataacaactgtaagccatcattcaaggaacacctaacccggctcatatcggagggcaacaaatccatagtcgtggtttacgacaacgtccttcattttgccggtatagtagctgttgacctaaatttagctgccgtaatgttcaggagtagttcagcggcttattttccagcatttttagcccgtcaacaattgagtcaaaggggacgattcctagaagaggactttaaaatggatgagatggtccctaatcattacccaatgcgttacaaggatctccctttctctaagtctccaattgaagattggcggcaattatactcaaatttttcccaacaggcacatccatccgctgtcatctggaatactataaaattccttgaacacgaatctctgacccaagttcacaactactatcaggttcctgtctttgctgttggcccactgcataagatgactcctacgtcctatatcgggtcacatgaggaagataatggttgcattacctggctagacaaacaacctcctaaatctgttgtatacattagctttggaagtttagcaacaatggaagccaaaatattgactgagatggcgttcggtctggccaaatcaaatcagaggttcctttgggcagtgcgtcctggactgatttctggttctgggtgggttgaatttttaccagaaggttttgtagaagaaactcgtggtcgaggtttgatcgtaaaatgggcacctcaaaaagaagtgctagctcattttgcagtaggtggtttctggtcacactgtggttggaacagttgcttggaatctatcagttctggcgtagttatgatgtgtcaaccctttatagcagatcaaggagtcaacgctcgatatgtgagttacgtatggaagataggcctcgaattggagcgtgttgaaagaggtgagatagaaaggatgataaagagagtaatggtagacgacgaaggcgaagaaatgagagtgagagtaaacgacatgaaaaagatggttaaagaagctcttgagattggtggttcgtcacaggaatcctttgaagggttagtagaatttcttttatcttgctaa

SEQ ID NO: 83 - DNA, 1425 bp, Artificial Sequence
  Synthetic Polynucleotide
atggtacagccgagagttttactgttcccttttcccgcgttggggcatgtgaaaccatttctatccctcgctgagcttttatcggacgccggaatcgatgtcgtttttctaagtacagaatataatcaccggcgtatttcaaacacggaagcacttgctagccgcttcccaactttacatttcgaaaccatacctgatggtttgccacctaatgaatctagagcattggccgacggccccctgtacttttctatgagggagggtactaagccaagattccgacaactcattcaatcactaaacgatggtaggtggcccataacatgcattatcacggatattatgttgtctagtcctatagaggttgctgaagaatttggcattccagtaatcgcattctgtccgtgtagcgctagatatctgtcaattcatttttttattcctaaattggtcgaggaaggacaaataccatacgcggatgacgatcctatcggtgaaatccagggagtgccgttatttgaagggttgcttcgtaggaatcacttaccaggttcctggtccgacaagtctgctgatatttcgttctctcacggtttaatcaaccaaactttagccgcaggaagagctagcgccttaatacttaataccttcgacgagctcgaagctccttttttgacacatttaagttcgatatttaacaaaatttatacgattggcccactgcatgcattgtcaaaaagtcgcctaggtgattccagttcttcagcttcggcgctttccggtttttggaaggaagacagagcctgcatgagctggttagattgtcaacccccccgatcggttgttttcgtgtcgttcggcagcactatgaaaatgaaggcagatgaattaagagagttttggtacggtctagtctcttcggggaaaccatttttatgcgttttacgttcagatgtagtctctggtggggaagcagctgaattgattgaacagatggcagaagaagagggtgctggcggaaagctgggcatggttgtggagtgggctgcgcaagaaaaagtattgtcacatcctgccgttggcggatttcttacacattgtggttggaatagcaccgtcgaaagcatcgcagctggtgttccgatgatgtgttggccaatactcggagatcaaccgtctaatgcaacttggatagacagagtgtggaagatcggcgtagagaggaacaatagagaatgggatcgactaacggtagaaaagatggttcgggccttgatggaaggtcagaaacgtgtcgagattcaacggtccatggaaaaattgtccaaactggctaatgaaaaagtcgttagagggggtttaagtttcgataacttagaggtgctcgttgaggacattaagaaactgaagccttataaattttaa

SEQ ID NO: 84 - DNA, 1458 bp, Artificial Sequence
  Synthetic Polynucleotide
atggcggagcaagctcacgatctattgcatgtactgctttttccgttccctgccgaaggacatataaaaccctttttatgcctcgcagaattattgtgtaatgctggcttccacgttacctttttgaacacggactacaatcataggcgcttacataacctgcatctacttgcagcccgattcccatcgttgcactttgaatccatttctgatgggttacctccagaccagccaagagatatcttggatcctaagttctttattagcatctgtcaagtgacaaaacccctctttagagagttactattatcatataagagaatttctagtgttcaaactggtcgtcctccaataacatgcgtcataactgatgtgatttttcggttcccgattgacgttgctgaagaacttgatatccctgtcttctcattttgtacgttctctgcaaggtttatgttcttgtatttttggattccaaaactcatcgaagacggtcagctcccttacccaaatggtaatataaaccaaaagctgtatggagtagcccccgaggctgaaggcttgcttagatgcaaagatttaccaggtcattgggcatttgctgatgaactcaaggacgatcaacttaacttcgtcgatcagaccactgcgagctccagatcgtcagggttaatattgaatacttttgacgatctggaagcaccatttcttggtagactatccacaatttttaaaaaaatttatgcagttggaccgatacatagtttgttgaacagtcaccattgtggtttgtggaaagaggaccactcttgtttagcttggttggattcacgtgccgctaagtctgtagttttcgtttcatttgggtcattagtgaagatcacgagtaggcaactaatggaattttggcatggccttcttaatagtggtaaaagctttctattcgtcttaaggtccgacgtagtggaaggcgatgatgagaaacaagttgtcaaggaaatatacgaaacaaaggcggagggaaaatggcttgtagttggttgggccccgcaggagaaagttttggcacacgaagctgtgggtggtttcttaacccattctgggtggaatagcattctggaatcgatcgcagcaggggtaccaatgatttcatgccccaagattggagaccagtcctctaattgtacttggataagcaaagtctggaaaatcggtttggagatggaagatagatacgacagagttagcgtcgaaaccatggtacgttctatcatggaacaagaaggcgagaagatgcaaaaaacaattgctgagctagcaaaacaggcgaagtataaggtgtcaaaggatggaacctcgtatcaaaatttagagtgtctgattcaagatattaagaaactaaaccaaatcgaaggctttataaacaatcctaacttctctgatctattaagggtgtaa

SEQ ID NO: 85 - DNA, 1476 bp, Artificial Sequence
  Synthetic Polynucleotide
atggtagccccaccaacaaatctgcatttcgttttgtttccactgatggctcaaggtcatttggtcccaatggtagatatagctagaatattggctcaaagaggtgcaaccgtgactataataacaactccatatcatgcaaacagagttagaccagttatttctagggctatcgcaacaaatctaaaaatacaactgttagagttgcaattaagatctactgaagctggtctaccagaaggttgcgagtctttcgaccaattgccttcattcgagtactggaaaaatatatcaactgctatagatttgttgcagcaaccagctgaagatttgctaagagaattgtctccaccaccagattgtattatttctgactttctgtttccttggactactgatgttgcaagaagattgaatatcccaagacttgtgtttaatggtccaggttgtttctatctattgtgcatacatgtagctatcacctctaacatattgggtgaaaacgaaccagtgtctagtaacactgaaagagtcgtcttgccaggtctacctgatagaattgaagtaactaagttacaaattgttggttcttctaggccagctaatgtcgatgaaatgggttcttggttgagagctgtggaagctgagaaagctagttttggtatagttgtaaacacttttgaggagttagaaccagagtacgtggaagaatataaaactgtaaaagataaaaaaatgtggtgtataggtccagtgtcattgtgtaataagactggtccagatttagcagaaagaggtaataaagctgctattacagaacataattgtttgaagtggttggatgaaagaaaactgggtagtgtgttgtatgtgtgtttgggttctttagctagaatttcagccgctcaagccattgaattgggtttaggtttagaatctataaatagaccatttatatggtgtgtgagaaatgagacggacgaattaaaaacttggtttttagacggttttgaggaaagagtaagagatagaggtttaattgtacatggttgggctcctcaagttttaattttatctcatccaactattggtggttttcttactcattgcggatggaatagtacaatagaaagtattacagctggagtaccaatgattacatggccattttttgcagatcaatttttaaatgaggcttttatagttgaagttttaaaaattggtgtaagaataggtgtagaaagagcatgtttatttggtgaggaagataaagttggtgttttggtaaaaaaagaagatgtgaaaaaggcagtcgaatgtttgatggatgaagacgaggacggtgatcaaagaagaaaaagagttatcgaattggctaaaatggctaaaatcgccatggctgaaggtggctcctcatacgagaacgtttcttccttgattagagacgtcaccgagactgtcagagccccacactaa

SEQ ID NO: 86 - DNA, 1488 bp, Artificial Sequence
  Synthetic Polynucleotide
atggtatcagaaactactaaatcttctccattgcattttgtattgttcccatttatggcccaaggtcatatgatcccaatggttgacatcgctagattattggctcaaagaggtgtcatcatcacaatagtcacaactccacataacgctgctagatttaagaatgtgttgaacagagcaattgaatcaggtttgccaatcaatttggtacaagtgaaattcccatatcttgaagcaggtttgcaagagggtcaagaaaacatcgattctttagatacaatggaaagaatgatcccattttttaaagctgtaaacttcttggaagaaccagtacagaaattgattgaggaaatgaatccaagaccatcatgcttgatttccgatttctgtcttccatatacttccaagattgccaaaaagtttaatatcccaaaaatcttattccatggtatgggttgtttttgccttctgtgtatgcatgtcttgagaaaaaatagagaaatactagataatttgaaatctgataaggaattattcactgttccagattttccagatagagttgaatttacaagaacacaagtaccagttgaaacttacgtgccagctggtgattggaaagatatatttgacggtatggtggaagctaacgaaacttcctatggagttattgtaaattcttttcaagaattggaacctgcttatgccaaagattataaggaagtcagaagtggtaaggcctggactattggtccagtatctttatgcaataaagttggtgcagataaggcagaaagaggtaacaaatctgacatagaccaagatgaatgtttaaaatggttggattccaagaaacatggtagtgtgttgtatgtctgccttggttcaatctgcaacttgccattgtcacaattaaaggaattgggtctaggtttggaagaatcacaaagaccattcatttgggtaattagaggttgggaaaaatataaagaattggtggaatggttttcagagtctggatttgaagacagaatacaagacagaggattattaatcaaaggttggtcccctcaaatgttaatattgtctcatcctagtgtcggtggttttttgacccattgtggttggaactctacattagaaggtataactgctggtttgccacttctaacttggccattgtttgctgatcagttctgcaacgaaaaattggttgttgaagtcctaaaagccggtgttagatctggtgtggaacaaccaatgaagtggggtgaagaagaaaagattggtgtgttggtggataaggaaggtgttaagaaggccgttgaggaattgatgggtgaatccgatgacgccaaggagcgccgccgcagagcaaaagaattaggtgatagtgcccataaagctgttgaagaaggtggatcttctcattctaacatatcttttttgttacaagacattatggagttagctgaaccaaacaactaa

SEQ ID NO: 87 - DNA, 1488 bp, Artificial Sequence
  Synthetic Polynucleotide
atggccttcgagaaaaacaacgaaccatttccactacattttgtcttgttccctttcatggctcagggtcatatgataccaatggttgatatcgctagattgctggctcagagaggtgttcttataacaatcgttacaaccccacataacgctgctagattcaaaaatgtcttgaatagagcaattgaatctggtttgccaattaacttggtccaagtcaagttcccataccaagaagccggtctgcaagagggacaagagaacatggatttgttgactactatggaacaaattacttcattttttaaggctgtgaacctgttaaaggaaccagtccaaaatttaatagaagaaatgtctccaagaccatcatgccttatatctgatatgtgtttgtcttacacttctgagatcgctaagaagttcaaaatcccaaagatattgttccatggtatgggttgtttctgcttattatgcgtgaatgttttgagaaaaaacagagaaatattagacaacttgaagtctgataaggaatatttcatcgtaccatatttcccagatagagtggaatttactagaccacaagttccagtcgagacttacgtcccagctggttggaaagaaatcttggaagacatggttgaagcagataagacatcatacggtgtaattgtaaactctttccaagaattggaaccagcttacgctaaagacttcaaagaagctagatcaggaaaggcatggactatcggtccagtgtccttatgtaataaggttggtgttgacaaggctgaaagaggtaataaatcagacattgatcaagatgaatgtttggagtggttggattcaaaagagccaggttcagtattatatgtgtgtttgggttctatctgtaaccttcctttatctcaattgttggagctaggtcttggtttagaggaatctcaaagaccatttatttgggtcattagaggttgggaaaaatacaaagagctggtcgaatggttttctgagagtggttttgaagacagaatccaagatagaggtttattaattaagggttggtcccctcaaatgttaattctttctcatccatctgtaggtggtttcttaactcattgcggttggaatagtactttagagggtatcactgctggtttacctatgttaacctggccattatttgctgatcaattttgtaatgagaaattagttgtacaaatactaaaagtaggtgtatctgctgaagtaaaagaggtgatgaaatggggtgaagaagaaaaaattggtgtgctagttgataaagagggcgtcaagaaggccgtcgaggagttgatgggtgaatccgatgatgccaaggaacgccgccgcagagctaaagaattgggtgagtctgctcataaggctgtagaagaaggtggttcttctcattcaaatattacattcctgttgcaagatataatgcaattggcacaatctaataactaa

SEQ ID NO: 88 - DNA, 1599 bp, Artificial Sequence
  Synthetic Polynucleotide
atgttaatgcatgcattgactcctacagctccatttttctccataaagccaaataccgaacctccatcagccactactcgtcagccaccaatggattctccaccacaaaaacctcacttcttgttgtttccattcatggctcaaggtcacatgatccctatgattgacttagctaagttgttagcccaaagaggggctattatcaccgtcgttaccactccacataacgctgccagatatcactctgttttggctagagctattgattccggtttgcatattcacgtcttgcaattacaattcccatgtaacgagggtggtttgccagaaggttgcgaaaactttgacttgttgccatctttaggttcagcctctactttctttagagcaaccttcttattgtacgaaccttctgaaaaggttttcgaagaattgatcccaagacctacatgtatcatatccgacatgtgtttaccatggacagtccgtttggctcagaaataccacgttccaagattggttttttattccttgtcatgttttttcttgttgtgcatgagatctttgaagaataaccaagctttaatttcttctaagtccgattctgagttggtcactttttccgatttgccagatccagtcgaatttttaaaatcacaattgcctaagtctaatgacgaagaaatggctaagttcggttacgagatcggtgaagctgatagacaatcccatggtgttattgttaacgttttcgaagagatggaaccaaaatacttagcagaatatagaaaggaaagagaatctcctgaaaaggtctggtgtgttggtccagtctccttgtgtaatgacaacaagttagacaaagcccaacgtggtaacaaggcttcaattgatgaaagagaatgtatcgagtggttggacggtcaacaaccatcttctgttgtttacgtctctttaggttctttgtgtaacttagttaccgcccaattgattgagttgggtttgggtttagaagcttctaacaagccattcatttgggttatcagaaaaggtaatattaccgaagaattacagaaatggttggtcgaatatgacttcgaggaaaagactaagggtcgtggtttggttatattgggttgggctccacaagtcttgattttatcccatccagcaatcggttgctttttaacacactgtgggtggaactcctccatcgaaggtatctcagccggtatgccaatgattacctggccattgttcgctgatcaagttttcaatgaaaagttgatcgttgaaatcttgagaataggtgtttctgtcggtatggaaaccgctatgcattggggtgaagaagaagaaaagggtgtcgtcgttaagagagaaaaagtcagagaggcaatagaaagagcaatggatggtgacgaaagagaagaacgtcgtgagagatgcaaggagttggccgaaatggctaagagagctgttgaagaaggtggttcatctcacagaaacttgactttgttgactgaagatattttggtcaatggtggtggtcaggaaagaatggatgacgccgatgacttcccaactatcgtcaactaa

SEQ ID NO: 89 - DNA, 1410 bp, Artificial Sequence
  Synthetic Polynucleotide
atggagcaggcgcacgatttactgcatgtcctccttttcccttacccagccaaagggcatataaagccgtttctatgcttggcagaattactgtgtaatgctggcttaaacgtgacatttttgaataccgactataaccaccgaaggttacataatttgcatttgttggccgcttgtttcccctccctacactttgaatcaattagtgatggtcttcaacctgaccaaccacgggatatcctagatccaaaattttatatttctatttgccaagtaacgaagccgctcttccgcgaactgttactatcgtacaaacgtactagctcagttcagacaggaagacctccaatcacttgtgtcataactgatgttatctttagatttcccattgacgtagcagaggaacttgacataccagttttctctttctgtaccttttctgctagattcatgtttttgtatttttggattcccaagttaatcgaagatggtcaacttccttacccaaacggaaatattaatcagaaactctatggggtcgcgcctgaggctgaaggtttattgagatgtaaggatttgcccggtcattgggcatttgcagatgaattgaaagacgatcaactaaacttcgtagatcaaacaactgcaagtttaaggagctcaggccttatattaaatacctttgacgatttagaagccccgtttctaggtagattgagcacaattttcaagaaaatctatgctgttggacctatacatgctttgctgaatagtcaccattgcggtttatggaaagaagaccattcctgcttagcgtggttggattcccgtgctgcccggtcggtggttttcgtgtcgttcggcagtcttgttaaaattacgtcaaggcaattaatggagttttggcacggtctgttgaatagtggtacttcttttctgtttgttttaagatctgacgtcgtcgaaggggatggagaaaaacaagtagttaaggagatatacgaaacgaaagctgaaggcaagtggcttgtcgttggatgggctcctcaggagaaagtgctagcacatgaagctgtgggtggcttcttaacccactccggatggaactctattttggagtcaatcgccgcgggtgtaccaatgattagttgtccaaagataggagaccaatcatctaactgcacttggatctcgaaagtgtggaagataggtctagaaatggaagatcagtacgacagagcaacagtcgaagcaatggtaagaagcataatgaaacatgaaggcgagaaaattcaaaaaacaatcgctgaattggccaagagagctaaatataaggtatctaaggatggtacctcttatagaaatttggagattttaatagaagatattaaaaaaatcaagcccaactaa

SEQ ID NO: 90 - DNA, 1377 bp, Artificial Sequence
  Synthetic Polynucleotide
atggaaaataaaacagaaactactgttagaagaagaagaagaattatactgtttccagtaccatttcaaggtcatatcaaccctattttgcaattggctaatgttctatactccaaaggtttctctatcacaatttttcatactaatttcaataagccaaagacctcaaactatccacattttacattcagatttattctggacaatgatccacaagatgaaagaatctccaatttgccaactcatggtccattggccggtatgagaatcccaatcattaacgaacatggtgccgatgaattgcgcagagaattggaattgttaatgttagcttcagaagaagatgaagaagtttcatgtttgatcactgatgctttgtggtactttgctcagtctgtggctgattctctaaatttaagaagacttgtacttatgacttcctcattgtttaacttccatgctcatgtgtctttgccacagtttgatgaattgggttacttggacccagatgataaaactagactggaggaacaagcatctggttttcctatgttgaaggtgaaagatataaaatctgcttatagtaattggcaaatattgaaggaaatcctaggtaaaatgatcaaacaaactaaagcttcttctggtgttatatggaatagttttaaggaattggaagaatctgaattggagacagtgatcagagaaattccagctccatctttcctgatcccattgccaaaacatttgaccgcctctagctcctctttgttggaccacgaccgcaccgtcttccaatggttggaccagcaacccccttcttccgttttgtatgtctcattcggttctacctcagaggttgacgagaaagactttctggaaatagctagaggtttggtggatagtaagcagtcttttttgtgggtcgtaagaccaggttttgttaaaggttctacttgggttgaaccactaccagatggttttttgggtgaaagaggtagaatcgtcaagtgggtcccacaacaagaggtgttggctcatggtgctatcggtgctttttggactcattctggttggaactccactctggagtctgtctgcgagggtgttcctatgatcttttctgatttcggtctggatcaaccactgaacgctagatacatgtctgatgtcttgaaggtgggtgtttacttggaaaatggttgggaaagaggtgaaatcgccaacgccattcgcagagtcatggtcgatgaagaaggtgaatacatcagacaaaatgctagagtgcttaagcagaaagccgacgtttctctgatgaaaggcggttcttcttatgaaagtttagaaagtttagtttcatacatatcttctctctaa

SEQ ID NO: 91 - DNA, 1377 bp, Artificial Sequence
  Synthetic Polynucleotide
atggaaaataaaactgaaacaactgttagaagaagaagaagaatcatcttgttcccagtcccattccaaggtcatattaacccaatcttgcaactggctaatgtgctgtactccaaaggtttttctatcactatttttcatactaattttaataaacctaaaacttctaattacccacatttcacatttagatttattttggacaatgacccacaagacgagagaatctccaacctgccaacccatggtccattggccggcatgcgcatcccaatcatcaacgaacatggtgccgatgaattgcgcagagaacttgaattgttgatgttagcatctgaagaagacgaggaagtttcctgtctgattactgacgctttgtggtattttgctcaatctgttgctgattctttgaatttgagaagattggttttgatgacatcttctttgtttaattttcatgctcatgttagtctaccacagtttgatgagcttggttacttagatccagatgataagactagactagaagaacaagcttctggtttcccaatgctaaaggtaaaggatatcaaatccgcttattccaattggcaaatcctaaaggaaatattgggtaaaatgatcaagcagacaagagcttcttctggtgttatctggaactcttttaaagagctagaggagtctgaattggaaacagtcattagagaaatcccagctccatcttttctaattccattgccaaaacatttgaccgcatcatcttcttctctgctagaccatgatagaactgttttccaatggttggatcaacaaccaccatcttccgtcttgtatgtttcttttggctccacttcagaggtggacgagaaagattttctggaaattgctagaggtttagtagatagtaaacagagttttttatgggtagtaagaccaggttttgttaaaggttctacatgggttgagccactacctgatggttttttgggtgaaagaggtagaatagttaaatgggtaccacaacaagaagtcttggcacatggtgccattggtgctttctggacacattctggatggaactctacacttgaatctgtttgtgaaggtgttccaatgattttctccgattttggtttggatcaaccattgaatgctagatacatgtcagacgtcctgaaggttggtgtttacctggaaaacggttgggaacgcggtgaaatcgccaacgccattcgcagagtcatggtggacgaggaaggtgaatacattagacaaaatgccagagtacttaagcaaaaagcagatgtctctttgatgaaaggtggttcttcttatgagtctttggaatcattagtgtcttatatctctagtctctaa

SEQ ID NO: 92 - DNA, 1452 bp, Artificial Sequence
  Synthetic Polynucleotide
atggaccaaatggctaaaatcgatgaaaaaaagccacatgtggtttttataccatttccagctcaatctcatatcaagtgcatgcttaagttggccagaatattgcatcaaaaaggtttatatattacatttattaatacagataccaaccatgaaagactggttgctagtggtggtacccagtggttagaaaatgctccaggtttctggtttaagaccgtcccagacggttttggttctgctaaagacgatggtgtgaaaccaactgatgctttgagagaacttatggattacttgaaaactaatttctttgacttgtttttggatttggttctgaaattggaagttccagctacttgtattatctgtgatggttgtatgacatttgccaacactatcagagctgccgaaaagttgaatataccagtcattttgttttggacaatggctgcttgcggatttatggcattttatcaagcaaaggttttaaaagaaaaagagattgtaccagtaaaggatgaaacttacttaactaatggttatttagatatggaaattgactggatacctggtatgaaaagaattagacttagagatttgccagagtttatattggccaccaaacagaattattttgccttcgagtttttgttcgaaactgcccaattggctgataaggtgtctcatatgattattcatacttttgaagaattggaggcttctttagtttctgagataaaatctattttcccaaatgtttataccattggtccacttcaattgttgttaaacaagattacacaaaaagaaacaaacaatgattcttatagtctttggaaagaagaaccagaatgcgtggaatggttgaactccaaagaaccaaatagtgttgtctatgtaaatttcggttcattggcagtgatgtccttgcaagatttggtcgagtttggttggggattagtaaattctaatcattattttttgtggattataagagctaatttgatcgatggtaagccagctgttatgccacaagaattgaaagaagctatgaacgagaaaggttttgttggttcctggtgttctcaagaggaagtcttgaatcatccagctgtgggcggtttccttactcattgcggttggggttctataatcgaatctctttctgctggtgttcctatgcttggatggccatctataggtgatcagagagctaactgccgtcagatgtgtaaagagtgggaagtgggtatggaaatcggtaaaaatgtcaaaagagacgaagttgagaaattggtgagaatgttgatggaaggactggaaggtgaaagaatgagaaaaaaagctttggaatggaagaaatcagctactttggctacttgctgcaacggttcttcctcattggacgtagaaaaattggcaaatgagattaaaaaattgtccagaaactaa

SEQ ID NO: 93 - DNA, 1362 bp, Artificial Sequence
  Synthetic Polynucleotide
atggacgcgcaacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttaataccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaagatggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagatataa

SEQ ID NO: 94 - DNA, 1455 bp, Artificial Sequence
  Synthetic Polynucleotide
atggaccagatggcaaaaattgatgagaagaaaccccacgttgtgtttataccattcccggcgcaaagtcatatcaagtgtatgctcaaactggcccgcattttgcatcaaaagggattatatattacatttatcaataccgatacgaaccacgaacgacttgtcgcttccgggggcactcaatggttagaaaatgctcctggtttctggtttaaaacagtacctgacggtttcggttctgcaaaagatgatggagttaagccaactgacgccttgagagaactaatggattacctaaaaactaactttttcgatctctttttggacttagtattaaagttagaggtccccgctacctgcataatttgtgatggctgcatgacattcgcgaatacgatcagagctgctgaaaaattgaatataccagttatacttttttggacaatggcagcctgtggttttatggcattttatcaggccaaagtgctgaaggaaaaagagattgttcctctgaaagacgaaacttacttgaccaacggatatttagatatggaaattgattggatcccaggtatgaaacgtattaggcttagagatctacccgagttcattctggccactaagcaaaattatttcgcatttgaatttttatttgaaacagctcaattggcggacaaagtatcgcatatgataatccataccttcgaagaattggaagctagcttagtgtcagaaatcaagtctatatttccgaacgtttacactattggacctttgcagctattgctgaataagataaccctcaaagagactaataatgactcatatagtctatggaaggaagagccagaatgtgttgagtggcttaactctaaggagccaaactccgtcgtgtacgttaacttcggttccttggctgtgatgtctttacaagatctcgtcgaatttgggtggggcttggttaattcaaatcactatttcttatggatcattagagccaatctgattgatggtaagccagctgttatgcctcaagaactcaaagaagccatgaacgagaaagggtttgtaggttcgtggtgttcgcaggaagaggtccttaatcatcctgtggtaggcggtttcttgacgcattgcggttggggaagtatcatagagagcctttcagcaggcgtgcctatgttaggatggccgagcattggggaccagagggcaaactgccggcaaatgtgtaaagaatgggaagtgggcatggagataggtaaaaatgttaagagagatgaagttgaaaaactggttcgtatgttgatggaaggtttggaaggagagcgaatgagaaaaaaggctttagagtggaaaaagtccgctacattagcaacgtgttgtaacgggtcttcatcactggacgtcgaaaaattggccaatgaaattaagaaattatcgcgtaattaataa

SEQ ID NO: 95 - DNA, 1371 bp, Artificial Sequence
  Synthetic Polynucleotide
atggaaaaccaaccacaaactactgtgagaagacatagaagaataattttgttcccaatgccattccaaggtcatattaacccaatgatccaattggctaacttgctgtattctaacggtttctctatagttatattgcatacaaacttcaatgctccaaaattctctaattatccaaattttactttcatctctgtcttggacaacgctgagaatgaaccattctctacatcctctagtttcgaatttgctcaaaactacacatttaagcaagatggtgctgatgaactaagacataagttggaactattgttggcatccggtaacgatgaaccagtttcttgtcttattactgatgctatttggcattttactcagtctgtggctgactccttgcaaattcctagaatcgtgttgagaactacttctgtctattgttccattgtgtatgcttcaatcccactatttgatgacagaggttacttcgccttggatgattctcatctggaagaacaagtcatggagtttccattattgaaagttaaggacattaagaagattggtattaaaagtatgaatgacccatatgctaagatgatatctgaaatggtaaaacaaattaaagcatcttccggtatcatctggaatagttttaaagaattagaggaaactgaacttgattctatcccacatgattttccaatacctagattcattatcccattccataaatatttcaacgccagttcttcttctttgttggaacaagatagaactgtgtttccatggttggatcagcaagcaccaaaatctgttctatacgtatcctttggatctttgtgtcaggttgacgaaaaagaatttttggagattgcccatggtttggtttattctcaacaaccatttttgtgggttgtcagaccaggtttcgtcaaagattccacttggctagaatcacttcctctgccagatggttttccaggtgaaagaggtagagtggtgaaatgggccccacagcaagaggtactagctcatgaagctactggtgcattttggacacattccggttggaatagtactttggagtccgtttgcgaaggtgttgctatgatttgttctccattttggggtgatcagcctattgacgctagatacatgtccgatgtctccaaggtcggcgtctacttggaaaacggtttccagagagacgagatttcctccgccatccgcagagtgatggtcgatgaagatggaaaagatattagagaaagagtaaaagttctaaaacagaaagtagatgactctttaatgatttccggttcttctaatgaaagtctggaatctttgatacattacatatcatctttctaa

SEQ ID NO: 96 - DNA, 1443 bp, Artificial Sequence
  Synthetic Polynucleotide
atggcaaacacggagtccttaaatgaccataagcaactgcacgtggccatgtttccgtggctagctttcggtcatatcattccctttttggaactttcaaaattcattgcggaaaaaggccataaagtcagttttttgtcgaccacacgtaatatacagagattacctactatcccatctaacctcagcccattgattaatttagttaagctcactttacctcgagttcaagaactaccagaggatgctgaagcaacaatagatgtacacacccaagacgtccaccatcttaagaaagcattcgatggactacagcctgaggtaacaagatttctggaaaaagaatctcctgattggataatttatgattttgccccatactggttgccctcagttgctgcggggcttaggatttcgcgcgcattctattccaactttaatgcttggttcatcgcattcttaggtgccagtgccgacgatttgatttctggttctggatacgaccatagaacgagggtagaaaactttatgactccgcccaagtgggtgccttttccaactaatgtttgttatagaaaatacgaagctgtcagaatggtgggcaatacctcagctaatgctagtggtatatcatctgtgtatcgtgtaggcatgatcctgaagggtagcgattgcatgtttatcagacattcttacgagttcgaaccacaatggttgacgttattggaaaagttacatcaccttcctgttgttccagtcggtttgctgcctccagaaaaaccgacaaacattgaagatggaaatgacgagacttgggatacagttaaaatgtggttagatggccaacagaaaggccacgtagtgtatgttgcgtttggttccgaagtgacgctctcgcgtagtgagcttgccgaattggcgttaggtctagagttatccgggttaccgtttttttgggcattgaggaaacccgttgcatcaaccgaatctaaattggttgaactcccagatggattcttagatcgcactagcgacagaggtttagtatggacttcttgggctcctcaactacaaatattatctcatgagagtgtgggaggatttcttacacattgtggatggagctcaatcgtcgaagctatgatgttcggtcaccccctaattatgttaccatgcctagcagaccaggggcttaacgctcgggtaatggttgataagaaagtgggcatagagattccgagaaatggtgaggacgggagctttaacaaggaatcagtcgcgaggtcggtaagggctgttgtcgccgatgatgaaggtaaaatttataaggaaaatgctatggaattgtcccgacttttcggggatacaaagatgggtaaaaaatacattaatcactttattgactatctagagaagactagaagaacccttaccgtgtagtaa

SEQ ID NO: 97 - protein, 466 aa, Stevia rebaudiana
MLLQSNPMENETETTVSRRRRILLFPVPFQGHINPMLQLANVLYSKGFSITIFHTNFNSPKTSNYPHFTFRFILDNDPQDKRISNLPTHGPAASIRIPFFNEYRADELRRELELLMLASEEDGEVSCLIADQIWYFTQSVADSLNLRRLVLVTSSLFNFHAHVSLPQFDELGYLDPDDKTRLEEQASGFPMLKVKDIKCSFSMWKKYKEYFENITKQTKASSGVIWNSFKELEESELETVIREIPAPSFLIPLPKHLTASSSSLLDHDRTVFPWLDQQPSRSVLYVSFGSGTEVLDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 98 - protein, 447 aa, Stevia rebaudiana,
MEEHGGRRRPLVVLTSCPFHGHMIPTLQLATTLHAKGFTIAIAHSKLNPPNPSNHPSDFIFLPLSDDIPAIDNSGSFTDFIRKLNNNCKPSFKEHLTRLISEGNKSIVVVYDNVLHFAGIVAVDLNLAAVMFRSSSAAYFPAFLARQQLSQRGRFLEEDFKMDEMVPNHYPMRYKDLPFSKSPIEDWRQLYSNFSQQAHPSAVIWNTIKFLEHESLTQVHNYYQVPVFAVGPLHKMTPTSYIGSHEEDNGCITWLDKQPPKSVVYISFGSLATMEAKILTEMAFGLAKSNQRFLWAVRPGLISGSGWVEFLPEGFVEETRGRGLIVKWAPQKEVLAHFAVGGFWSHCGWNSCLESISSGVVMMCQPFIADQGVNARYVSYVWKIGLELERVERGEIERMIKRVMVDDEGEEMRVRVNDMKKMVKEALEIGGSSQESFEGLVEFLLSC

SEQ ID NO: 99 - protein, 474 aa, Stevia rebaudiana
MVQPRVLLFPFPALGHVKPFLSLAELLSDAGIDVVFLSTEYNHRRISNTEALASRFPTLHFETIPDGLPPNESRALADGPLYFSMREGTKPRFRQLIQSLNDGRWPITCIITDIMLSSPIEVAEEFGIPVIAFCPCSARYLSIHFFIPKLVEEGQIPYADDDPIGEIQGVPLFEGLLRRNHLPGSWSDKSADISFSHGLINQTLAAGRASALILNTFDELEAPFLTHLSSIFNKIYTIGPLHALSKSRLGDSSSSASALSGFWKEDRACMSWLDCQPPRSVVFVSFGSTMKMKADELREFWYGLVSSGKPFLCVLRSDVVSGGEAAELIEQMAEEEGAGGKLGMVVEWAAQEKVLSHPAVGGFLTHCGWNSTVESIAAGVPMMCWPILGDQPSNATWIDRVWKIGVERNNREWDRLTVEKMVRALMEGQKRVEIQRSMEKLSKLANEKVVRGGLSFDNLEVLVEDIKKLKPYKF

SEQ ID NO: 100 - protein, 485 aa, Siraitia grosvenorii
MAEQAHDLLHVLLFPFPAEGHIKPFLCLAELLCNAGFHVTFLNTDYNHRRLHNLHLLAARFPSLHFESISDGLPPDQPRDILDPKFFISICQVTKPLFRELLLSYKRISSVQTGRPPITCVITDVIFRFPIDVAEELDIPVFSFCTFSARFMFLYFWIPKLIEDGQLPYPNGNINQKLYGVAPEAEGLLRCKDLPGHWAFADELKDDQLNFVDQTTASSRSSGLILNTFDDLEAPFLGRLSTIFKKIYAVGPIHSLLNSHHCGLWKEDHSCLAWLDSRAAKSVVFVSFGSLVKITSRQLMEFWHGLLNSGKSFLFVLRSDVVEGDDEKQVVKEIYETKAEGKWLVVGWAPQEKVLAHEAVGGFLTHSGWNSILESIAAGVPMISCPKIGDQSSNCTWISKVWKIGLEMEDRYDRVSVETMVRSIMEQEGEKMQKTIAELAKQAKYKVSKDGTSYQNLECLIQDIKKLNQIEGFINNPNFSDLLRV

SEQ ID NO: 101 - protein, 491 aa, Stevia rebaudiana
MVAPPTNLHFVLFPLMAQGHLVPMVDIARILAQRGATVTIITTPYHANRVRPVISRAIATNLKIQLLELQLRSTEAGLPEGCESFDQLPSFEYWKNISTAIDLLQQPAEDLLRELSPPPDCIISDFLFPWTTDVARRLNIPRLVFNGPGCFYLLCIHVAITSNILGENEPVSSNTERVVLPGLPDRIEVTKLQIVGSSRPANVDEMGSWLRAVEAEKASFGIVVNTFEELEPEYVEEYKTVKDKKMWCIGPVSLCNKTGPDLAERGNKAAITEHNCLKWLDERKLGSVLYVCLGSLARISAAQAIELGLGLESINRPFIWCVRNETDELKTWFLDGFEERVRDRGLIVHGWAPQVLILSHPTIGGFLTHCGWNSTIESITAGVPMITWPFFADQFLNEAFIVEVLKIGVRIGVERACLFGEEDKVGVLVKKEDVKKAVECLMDEDEDGDQRRKRVIELAKMAKIAMAEGGSSYENVSSLIRDVTETVRAPH

SEQ ID NO: 102 - protein, 495 aa, Stevia rebaudiana
MVSETTKSSPLHFVLFPFMAQGHMIPMVDIARLLAQRGVIITIVTTPHNAARFKNVLNRAIESGLPINLVQVKFPYLEAGLQEGQENIDSLDTMERMIPFFKAVNFLEEPVQKLIEEMNPRPSCLISDFCLPYTSKIAKKFNIPKILFHGMGCFCLLCMHVLRKNREILDNLKSDKELFTVPDFPDRVEFTRTQVPVETYVPAGDWKDIFDGMVEANETSYGVIVNSFQELEPAYAKDYKEVRSGKAWTIGPVSLCNKVGADKAERGNKSDIDQDECLKWLDSKKHGSVLYVCLGSICNLPLSQLKELGLGLEESQRPFIWVIRGWEKYKELVEWFSESGFEDRIQDRGLLIKGWSPQMLILSHPSVGGFLTHCGWNSTLEGITAGLPLLTWPLFADQFCNEKLVVEVLKAGVRSGVEQPMKWGEEEKIGVLVDKEGVKKAVEELMGESDDAKERRRRAKELGDSAHKAVEEGGSSHSNISFLLQDIMELAEPNN

SEQ ID NO: 103 - protein, 495 aa, Stevia rebaudiana
MAFEKNNEPFPLHFVLFPFMAQGHMIPMVDIARLLAQRGVLITIVTTPHNAARFKNVLNRAIESGLPINLVQVKFPYQEAGLQEGQENMDLLTTMEQITSFFKAVNLLKEPVQNLIEEMSPRPSCLISDMCLSYTSEIAKKFKIPKILFHGMGCFCLLCVNVLRKNREILDNLKSDKEYFIVPYFPDRVEFTRPQVPVETYVPAGWKEILEDMVEADKTSYGVIVNSFQELEPAYAKDFKEARSGKAWTIGPVSLCNKVGVDKAERGNKSDIDQDECLEWLDSKEPGSVLYVCLGSICNLPLSQLLELGLGLEESQRPFIWVIRGWEKYKELVEWFSESGFEDRIQDRGLLIKGWSPQMLILSHPSVGGFLTHCGWNSTLEGITAGLPMLTWPLFADQFCNEKLVVQILKVGVSAEVKEVMKWGEEEKIGVLVDKEGVKKAVEELMGESDDAKERRRRAKELGESAHKAVEEGGSSHSNITFLLQDIMQLAQSNN

SEQ ID NO: 104 - protein, 532 aa, Siraitia grosvenorii
MLMHALTPTAPFFSIKPNTEPPSATTRQPPMDSPPQKPHFLLFPFMAQGHMIPMIDLAKLLAQRGAIITVVTTPHNAARYHSVLARAIDSGLHIHVLQLQFPCNEGGLPEGCENFDLLPSLGSASTFFRATFLLYEPSEKVFEELIPRPTCIISDMCLPWTVRLAQKYHVPRLVFYSLSCFFLLCMRSLKNNQALISSKSDSELVTFSDLPDPVEFLKSQLPKSNDEEMAKFGYEIGEADRQSHGVIVNVFEEMEPKYLAEYRKERESPEKVWCVGPVSLCNDNKLDKAQRGNKASIDERECIEWLDGQQPSSVVYVSLGSLCNLVTAQLIELGLGLEASNKPFIWVIRKGNITEELQKWLVEYDFEEKTKGRGLVILGWAPQVLILSHPAIGCFLTHCGWNSSIEGISAGMPMITWPLFADQVFNEKLIVEILRIGVSVGMETAMHWGEEEEKGVVVKREKVREAIERAMDGDEREERRERCKELAEMAKRAVEEGGSSHRNLTLLTEDILVNGGGQERMDDADDFPTIVN

SEQ ID NO: 105 - protein, 469 aa, Stevia rebaudiana
MEQAHDLLHVLLFPYPAKGHIKPFLCLAELLCNAGLNVTFLNTDYNHRRLHNLHLLAACFPSLHFESISDGLQPDQPRDILDPKFYISICQVTKPLFRELLLSYKRTSSVQTGRPPITCVITDVIFRFPIDVAEELDIPVFSFCTFSARFMFLYFWIPKLIEDGQLPYPNGNINQKLYGVAPEAEGLLRCKDLPGHWAFADELKDDQLNFVDQTTASLRSSGLILNTFDDLEAPFLGRLSTIFKKIYAVGPIHALLNSHHCGLWKEDHSCLAWLDSRAARSVVFVSFGSLVKITSRQLMEFWHGLLNSGTSFLFVLRSDVVEGDGEKQVVKEIYETKAEGKWLVVGWAPQEKVLAHEAVGGFLTHSGWNSILESIAAGVPMISCPKIGDQSSNCTWISKVWKIGLEMEDQYDRATVEAMVRSIMKHEGEKIQKTIAELAKRAKYKVSKDGTSYRNLEILIEDIKKIKPN

SEQ ID NO: 106 - protein, 458 aa, Stevia rebaudiana
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 107 - protein, 458 aa, Stevia rebaudiana
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 108 - protein, 483 aa, Stevia rebaudiana
MDQMAKIDEKKPHVVFIPFPAQSHIKCMLKLARILHQKGLYITFINTDTNHERLVASGGTQWLENAPGFWFKTVPDGFGSAKDDGVKPTDALRELMDYLKTNFFDLFLDLVLKLEVPATCIICDGCMTFANTIRAAEKLNIPVILFWTMAACGFMAFYQAKVLKEKEIVPVKDETYLTNGYLDMEIDWIPGMKRIRLRDLPEFILATKQNYFAFEFLFETAQLADKVSHMIIHTFEELEASLVSEIKSIFPNVYTIGPLQLLLNKITQKETNNDSYSLWKEEPECVEWLNSKEPNSVVYVNFGSLAVMSLQDLVEFGWGLVNSNHYFLWIIRANLIDGKPAVMPQELKEAMNEKGFVGSWCSQEEVLNHPAVGGFLTHCGWGSIIESLSAGVPMLGWPSIGDQRANCRQMCKEWEVGMEIGKNVKRDEVEKLVRMLMEGLEGERMRKKALEWKKSATLATCCNGSSSLDVEKLANEIKKLSRN

SEQ ID NO: 109 - protein, 453 aa, Siraitia grosvenorii
MDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFNTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKI

SEQ ID NO: 110 - protein, 483 aa, Stevia rebaudiana
MDQMAKIDEKKPHVVFIPFPAQSHIKCMLKLARILHQKGLYITFINTDTNHERLVASGGTQWLENAPGFWFKTVPDGFGSAKDDGVKPTDALRELMDYLKTNFFDLFLDLVLKLEVPATCIICDGCMTFANTIRAAEKLNIPVILFWTMAACGFMAFYQAKVLKEKEIVPLKDETYLTNGYLDMEIDWIPGMKRIRLRDLPEFILATKQNYFAFEFLFETAQLADKVSHMIIHTFEELEASLVSEIKSIFPNVYTIGPLQLLLNKITLKETNNDSYSLWKEEPECVEWLNSKEPNSVVYVNFGSLAVMSLQDLVEFGWGLVNSNHYFLWIIRANLIDGKPAVMPQELKEAMNEKGFVGSWCSQEEVLNHPVVGGFLTHCGWGSIIESLSAGVPMLGWPSIGDQRANCRQMCKEWEVGMEIGKNVKRDEVEKLVRMLMEGLEGERMRKKALEWKKSATLATCCNGSSSLDVEKLANEIKKLSRN

SEQ ID NO: 111 - protein, 456 aa, Stevia rebaudiana
MENQPQTTVRRHRRIILFPMPFQGHINPMIQLANLLYSNGFSIVILHTNFNAPKFSNYPNFTFISVLDNAENEPFSTSSSFEFAQNYTFKQDGADELRHKLELLLASGNDEPVSCLITDAIWHFTQSVADSLQIPRIVLRTTSVYCSIVYASIPLFDDRGYFALDDSHLEEQVMEFPLLKVKDIKKIGIKSMNDPYAKMISEMVKQIKASSGIIWNSFKELEETELDSIPHDFPIPRFIIPFHKYFNASSSSLLEQDRTVFPWLDQQAPKSVLYVSFGSLCQVDEKEFLEIAHGLVYSQQPFLWVVRPGFVKDSTWLESLPLPDGFPGERGRVVKWAPQQEVLAHEATGAFWTHSGWNSTLESVCEGVAMICSPFWGDQPIDARYMSDVSKVGVYLENGFQRDEISSAIRRVMVDEDGKDIRERVKVLKQKVDDSLMISGSSNESLESLIHYISSF

SEQ ID NO: 112 - protein, 479 aa, Stevia rebaudiana
MANTESLNDHKQLHVAMFPWLAFGHIIPFLELSKFIAEKGHKVSFLSTTRNIQRLPTIPSNLSPLINLVKLTLPRVQELPEDAEATIDVHTQDVHHLKKAFDGLQPEVTRFLEKESPDWIIYDFAPYWLPSVAAGLRISRAFYSNFNAWFIAFLGASADDLISGSGYDHRTRVENFMTPPKWVPFPTNVCYRKYEAVRMVGNTSANASGISSVYRVGMILKGSDCMFIRHSYEFEPQWLTLLEKLHHLPVVPVGLLPPEKPTNIEDGNDETWDTVKMWLDGQQKGHVVYVAFGSEVTLSRSELAELALGLELSGLPFFWALRKPVASTESKLVELPDGFLDRTSDRGLVWTSWAPQLQILSHESVGGFLTHCGWSSIVEAMMFGHPLIMLPCLADQGLNARVMVDKKVGIEIPRNGEDGSFNKESVARSVRAVVADDEGKIYKENAMELSRLFGDTKMGKKYINHFIDYLEKTRRTLTV

SEQ ID NO: 113 - DNA, 1563 bp, Artificial Sequence
  Synthetic Polynucleotide
atggaaatgtcctcaagtgtcgcagccacaatcagtatctggatggtcgtcgtatgtatcgtaggtgtaggttggagagtcgtaaattgggtttggttgctgccaaagaaattggaaaagagattgagagaacaaggtttggccggtaattcttacagattgttgttcggtgacttgaaggaaagagctgcaatggaagaacaagcaaattcaaagcctataaacttctcccatgacatcggtccaagagttttcccttcaatgtacaagaccatccaaaactacggtaaaaactcctacatgtggttaggtccataccctagagtccacatcatggatccacaacaattgaagaccgtttttactttggtctacgacattcaaaagccaaatttgaaccctttgattaaattcttgttagatggtatcgttacacatgaaggtgaaaagtgggctaagcacagaaagattattaacccagcattccatttggaaaagttgaaggatatgatacctgctttctttcactcatgtaatgaaatcgtcaacgaatgggaaagattgatttcaaaagaaggttcctgcgaattggatgtaatgccttatttgcaaaatttggccgctgacgccatttcaagaaccgcttttggttcttcatacgaagaaggtaaaatgatcttccaattgttgaaggaattgactgatttggttgtcaaggtagcttttggtgtttatattccaggttggagattcttgcctacaaagagtaacaacaaaatgaaggaaattaatagaaaaatcaagtctttgttgttgggtatcattaacaagagacaaaaggcaatggaagaaggtgaagccggtcaatctgatttgttgggtatattaatggaaagtaattctaacgaaatccaaggtgaaggtaataacaaggaagatggcatgtctattgaagacgtcatcgaagagtgtaaggtattttatataggtggtcaagaaactacagcaagattattgatctggactatgatattgttgtccagtcatacagaatggcaagaaagagccagaaccgaagtcttgaaggtatttggtaataagaaaccagatttcgacggtttgtcaagattgaaggtagttactatgatcttgaacgaagttttaagattgtacccacctgcttccatgttgacaagaatcatccaaaaggaaacaagagttggtaaattaaccttgccagcaggtgttatcttgataatgcctatcatcttgatacatagagatcacgacttgtggggtgaagatgctaacgagtttaaaccagaaagattcagtaaaggtgtttctaaggcagccaaagtccaaccagcctttttcccttttggttggggtcctagaatttgcatgggtcaaaacttcgctatgatcgaagctaagatggcattgagtttgatcttgcaaagattttctttcgaattgtcttcatcctacgttcatgcaccaactgtcgtcttcactacacaaccacaacacggtgcccacatcgttttgagaaagttataa

SEQ ID NO: 114 - DNA, 1422 bp, Artificial Sequence
  Synthetic Polynucleotide
atgtggactgtcgtgctcggtttggcgacgctgtttgtcgcctactacatccattggattaacaaatggagagattccaagttcaacggagttctgccgccgggcaccatgggtttgccgctcatcggagagacgattcaactgagtcgacccagtgactccctcgacgttcaccctttcatccagaaaaaagttgaaagatacgggccgatcttcaaaacatgtctggccggaaggccggtggtggtgtcggcggacgcagagttcaacaactacataatgctgcaggaaggaagagcagtggaaatgtggtatttggatacgctctccaaatttttcggcctcgacaccgagtggctcaaagctctgggcctcatccacaagtacatcagaagcattactctcaatcacttcggcgccgaggccctgcgggagagatttcttccttttattgaagcatcctccatggaagcccttcactcctggtctactcaacctagcgtcgaagtcaaaaatgcctccgctctcatggtttttaggacctcggtgaataagatgttcggtgaggatgcgaagaagctatcgggaaatatccctgggaagttcacgaagcttctaggaggatttctcagtttaccactgaattttcccggcaccacctaccacaaatgcttgaaggatatgaaggaaatccagaagaagctaagagaggttgtagacgatagattggctaatgtgggccctgatgtggaagatttcttggggcaagcccttaaagataaggaatcagagaagttcatttcagaggagttcatcatccaactgttgttttctatcagttttgctagctttgagtccatctccaccactcttactttgattctcaagctccttgatgaacacccagaagtagtgaaagagttggaagctgaacacgaggcgattcgaaaagctagagcagatccagatggaccaattacttgggaagaatacaaatccatgacttttacattacaagtcatcaatgaaaccctaaggttggggagtgtcacacctgccttgttgaggaaaacagttaaagatcttcaagtaaaaggatacataatcccggaaggatggacaataatgcttgtcaccgcttcacgtcacagagacccaaaagtctataaggaccctcatatcttcaatccatggcgttggaaggacttggactcaattaccatccaaaagaacttcatgccttttgggggaggcttaaggcattgtgctggtgctgagtactctaaagtctacttgtgcaccttcttgcacatcctctgtaccaaataccgatggaccaaacttgggggaggaaggattgcaagagctcatatattgagttttgaagatgggttacatgtgaagttcacacccaaggaatga

SEQ ID NO: 115 - DNA, 2106 bp, Artificial Sequence
  Synthetic Polynucleotide
atgaaggtgtcgccttttgagttcatgagtgccataattaaaggcagaatggacccgagcaattcatcttttgaatccacaggagaagtagcatctgtcatctttgagaaccgagaattggttgcgattttaaccacgtcaatagctgttatgattgggtgtttcgtggttcttatgtggcgtagggctggttccagaaaagtcaagaatgtcgaactacccaaaccactgatcgttcacgaaccagagcctgaagtagaagatggtaagaaaaaggtaagcatcttctttggtactcagacaggaactgccgagggcttcgcaaaagctttggcagatgaagctaaggcgcgctatgaaaaagccacttttagagttgtcgacctcgatgattacgcggctgacgatgaccaatatgaagagaaattaaaaaacgagtctttcgcagtatttctattggcaacatacggtgatggtgaaccaaccgataatgctgcaaggttctataagtggtttgccgaagggaaagagcgtggcgaatggttacaaaacttacattacgctgtttttggattgggtaatcggcagtatgaacattttaataaaattgcaaaggtggccgatgagcttttagaagctcaaggtgggaacagactcgtaaaagttggcctgggggatgacgatcaatgcatagaagacgatttctcagcttggagagaaagtttgtggcccgaacttgacatgctcttaagagatgaagatgatgctacaactgttacgaccccttacactgctgccgtcttggagtatcgagtggtgttccacgatagcgcagatgtcgctgcggaggacaagtcttggattaatgccaacggtcatgctgttcacgacgctcaacatcctttccgctctaatgtagttgtgagaaaagaactgcatacatccgcctctgatagaagttgttcgcatttagaatttaacatatcaggctctgcactaaattatgagactggagatcatgtaggtgtttactgcgaaaaccttacagaaaccgtagatgaagcattgaatttgctaggtctttccccggaaacctatttttcaatctatactgataacgaggacggaacaccactaggaggttcctcactaccccctccatttcccagctgtacgctaaggacggcattaacaaggtacgcggacttgttgaatagtccaaagaagagtgcacttctggctttagccgctcacgcatccaatccagttgaagcggatcgtttaagatacctcgcttccccagcagggaaagatgaatatgcccaatctgtgattggtagccagaaaagtttactcgaggtcatggcagagtttccctcagcgaagcctcctttgggcgttttctttgctgcggttgcacctcgactccaaccgcgtttctacagtatttcctctagtccacggatggcaccatctcgtatccatgttacttgtgcgttggtgtacgataagatgccgactggccgcatacacaaaggtgtctgctcaacttggatgaagaatagtgtaccaatggaaaaatctcatgagtgttcgtgggcaccaatattcgttaggcaatcaaattttaagcttccagctgaatccaaagtcccaattatcatggttggccctgggaccggtctagcaccttttagaggatttctacaagaaagactagccttaaaggaatctggtgtggaattgggcccgtctattcttttcttcggatgcagaaacagaagaatggattatatttatgaagatgagttaaacaattttgttgaaacaggggctctttcagaattagtaattgccttttcaagggaaggtcctaccaaagaatacgttcagcataaaatggccgagaaagcttcagacatctggaatttgatcagtgaaggtgcttatttgtacgtatgtggcgatgctaaaggtatggctaaggatgtgcataggacgcttcacactataatgcaagaacagggtagtttagacagttcgaaggccgaatctatggtgaagaacttgcaaatgaatggtagatatttgcgtgatgtgtggtaa

SEQ ID NO: 116 - DNA, 2079 bp, Artificial Sequence
  Synthetic Polynucleotide
atgacctctgcattgtatgcttctgatcttttcaaacaattaaagagtataatgggtactgactccttgtctgatgatgtagttttggtaatagctactacatctttagctctagtcgctggttttgtggtcttgctttggaagaagactactgctgatagatccggtgaattgaaacctctgatgattcctaaatctttgatggctaaagatgaagacgatgatttggacctgggctctggtaagacaagagtttctattttttttggtactcaaactggtactgccgagggttttgctaaggctttgtctgaggaaattaaagctagatatgaaaaggccgcagttaaggtgattgatttggatgactatgctgctgatgatgatcaatacgaagaaaaattgaagaaagaaactttggcattcttctgtgtggctacttacggtgatggtgaaccaactgacaacgctgctagattttataaatggttcactgaggaaaatgaaagagatattaagttacaacaattggcttatggtgtttttgccctaggaaatagacaatacgagcattttaataaaatcggtatcgttttggacgaggaactatgtaagaaaggtgctaaaagattaattgaagttggtttaggtgatgacgatcaatcaattgaagatgactttaacgcttggaaagagtctttgtggtctgagttggataaactgttgaaggatgaagatgacaaatcagtagcaacaccatatactgctgttataccagaatatagagttgttactcatgatccaagatttactactcagaaatctatggagtctaatgttgctaacggtaatactactattgatattcatcatccatgcagagtagacgttgccgttcaaaaagaattgcatacccatgagtccgatagatcttgtatccatcttgagttcgatatttctaggactggtattacctatgaaactggtgaccatgtgggtgtttatgcagaaaatcatgtcgaaatagttgaagaagctggtaagttgttgggtcattccttggacctggtcttttctatccatgctgacaaagaagatggaagtccattggaatctgctgtccctccaccatttccaggaccatgcactttgggtactggtttggctagatatgcagacttgttgaatccaccaagaaaatcagcattggttgctctggctgcttatgcaaccgagcctagtgaagctgaaaaattgaagcatcttacttctccagatggtaaagatgaatactctcaatggattgttgcttctcaaagaagtttattagaagtaatggcagcatttccatctgctaaaccaccattaggtgttttctttgctgctatcgctccaagattacagccaagatattattcaatatcttcttcaccaagattggctccatctagggttcatgtcacttctgctctagtttacggtccaacaccaactggtagaatccataagggtgtttgttccacttggatgaagaatgctgttccagcagagaaatctcatgaatgctctggtgctccaatttttataagagcttctaactttaaattaccatctaatccatctactccaatagtaatggtaggaccaggtactggtttagcaccatttagaggtttccttcaagaaagaatggctttaaaagaggacggtgaagaactgggttcttctctgttattctttggttgtagaaatagacaaatggactttatttacgaagatgaattgaataattttgttgatcagggagtaatttccgagttgataatggctttttctagggaaggtgctcaaaaagagtacgtccaacataaaatgatggaaaaagctgctcaggtatgggatttaattaaagaagaaggttatttgtatgtatgcggtgacgctaaaggtatggcaagagatgtacatagaactttgcatactatagtgcaagaacaagaaggtgtgtcttctagtgaagctgaggccattgttaagaaactacaaactgaaggtagatatctgagagatgtatggtaa

SEQ ID NO: 117 - DNA, 951 bp, Artificial Sequence
  Synthetic Polynucleotide
atggatgaaatcgaacatattaccatcaatacaaatggaatcaaaatgcatattgcgtcagtcggcacaggaccagttgttctcttgctacacggctttccagaattatggtactcttggagacaccaactactttacctgtcctccgttgggtacagagcaatagctccagatttgagaggctatggcgatactgacagtccagctagtcctacctcttatactgctcttcatattgtaggtgacctggtcggcgcattagacgaattgggaatagaaaaggtctttttagtgggtcatgactggggtgctattatcgcatggtacttttgtttgtttagaccagatagaattaaagcacttgtgaatttgtctgtccagtttatcccacgtaacccagcaataccttttatagaaggtttcagaacagcttttggtgatgacttctacatttgtagatttcaagtacctggggaagctgaagaggatttcgcgtctatcgatactgctcaattgtttaaaacttcattatgcaatagaagctcagcccctccttgtttgcctaaagagattggttttagggctatcccaccaccagaaaatctgccatcttggctcacagaggaagatatcaacttctacgcagccaagtttaaacaaactggttttactggtgcccttaactattatagagcattcgacttgacatgggaattaacagccccatggacaggagcccagatccaagttcctgtaaagttcatagttggtgattcagatctcacgtaccatttccctggtgctaaggaatacatccacaacggagggtttaaaagagatgtgccactattagaggaagttgttgtggtaaaagatgcctgccacttcattaaccaagagcgaccacaagagattaatgctcatattcatgacttcatcaataagttctaa

SEQ ID NO: 118 - DNA, 1016 bp, Artificial Sequence
  Synthetic Polynucleotide
atgaaagtaagaatttttgaaaattcgaattcagacgcgattgaacatagaaccgtaagtgttaatggtatcaatatgcatgtggcagaaaagggagagggacctgtcgtgttgttgcttcatggtttcccagaattgtggtacagttggagacatcaaatattggctctttcctctttaggttacagagctgtcgcaccagacttacgaggctacggggatacagatgccccagggtcaatttcatcatacacatgctttcacatcgtaggagatctcgtggctctagttgagtctctgggtatggacagggtttttgttgtagcccacgattggggtgccatgatcgcttggtgtttgtgtctgtttagacctgaaatggttaaagcttttgtttgtctctccgtcccattcagacagagaaaccctaagatgaaaccagttcaaagtatgagagcctttttcggcgatgattactatatttgcagatttcaaaatcctggggaaatcgaagaggagatggctcaagtgggtgcaagggaagtcttaagaggaattctaacatctcgtcgtcctggaccaccaatcttaccaaaagggcaagcttttagagcaagaccaggagcatccactgcattgccatcttggctatctgaaaaagatctgtcatttttcgcttctaagtatgatcaaaagggctttacaggcccactaaactactacagagccatggatcttaattgggaattgactgcgtcatggactggtgtccaagttaaagtacctgtcaaatacatcgtgggtgacgttgacatggtttttacgactcctggtgtaaaggaatatgtcaacggcggtggtttcaaaaaggacgttccatttttacaggaagtggtaatcatggaaggcgttggtcatttcattaatcaggaaaaacctgaggagatttcatctcatatacacgatttcataagcaaattcgagctcttaattaacaattcttcgccagaggttaa

SEQ ID NO: 119 - DNA, 951 bp, Artificial Sequence
  Synthetic Polynucleotide
atggaccagatcgaacacattacgataaataccaacggaattaagatgcatatagcgagtgtgggtacagggccagtcgttcttctactgcatggtttccctgagttgtggtactcctggagacatcaactcttatatttgtcttcggttggatatcgcgctattgcaccggatttaaggggctacggtgatactgactcacccgccagccctacttcttatacagctttacacatcgtaggcgatctggtaggtgcattggatgaactaggaatagaaaaagtttttctagtgggtcatgactggggcgccattattgcttggtatttttgccttttccgtccagatagaatcaaagcgttagttaatttgtccgtccaatttattccacgaaaccctgcaatccccttcattgaagggtttagaacagccttcggtgacgatttttacatgtgtagatttcaagtcccaggcgaggctgaagaggattttgcctctatagatactgctcagctgttcaagaccagtctttgtaataggtcatcggctcctccatgtttgcccaaagaaatcggtttccgggcaattccaccgcctgaaaacttaccaagctggttgaccgaggaagacattaactactatgcagcgaagtttaaacaaacgggtttcactggtgctctcaattattaccgtgcatttgatttaacatgggagttaacagccccctggactggtgctcagatacaagtgccggttaagttcatagtaggggattcagacttgacatatcattttccaggagccaaagaatatatacacaatggaggttttaaaaaagatgtacctcttttggaagaagtagttgtggtgaaggatgcatgccatttcatcaaccaagaaaggccacaagaaattaatgctcacatccatgactttatcaataaattctaa

SEQ ID NO: 120 - DNA, 951 bp, Artificial Sequence
  Synthetic Polynucleotide
atggaaaagattgaacacaccactatttctaccaatggtatcaacatgcatgttgcctctattggttctggtccagctgtcttgttcttgcacggtttcccagaattgtggtattcttggagacaccaattattattcttgtcttccatgggttacagagctatcgctccagacttaagaggttttggtgacaccgacgctccaccatctccatcttcttacaccgctcaccacattgtcggtgacttggtcggtttgttagaccaattgggtattgaccaagtttttttggttggtcacgactggggtgctatgatggcctggtacttttgtttgttccgtccagatagagttaaggctttggtcaatttatctgtccacttcttacgtagacacccatctatcaaatttgttgatggtttcagagccttattaggtgatgatttttacttctgtcaattccaagaaccaggtgtcgctgaagccgacttcggttctgtcgatgttgctaccatgttgaagaaattcttgaccatgagagatccaagacctccaatgattcctaaggaaaagggtttcagagccttggaaactccagatccattgccagcctggttaactgaagaagacattgactacttcgccggtaagtttcgtaagaccggttttaccggtggttttaattactacagagccttcaacttgacttgggagttgaccgctccatggtctggttctgaaatcaaggtcgctgccaagttcattgttggtgatttagacttggtttatcacttccctggtgccaaggagtatatccatggtggtggtttcaaaaaggacgtccctttgttggaggaagttgttgttgttgatggtgctgctcacttcatcaaccaagaaagaccagctgaaatttcttccttgatttacgactttatcaagaagttctaa

SEQ ID NO: 121 - DNA, 945 bp, Artificial Sequence
  Synthetic Polynucleotide
atggagaagattgaacactctactatcgctactaatggtatcaatatgcacgttgcctctgctggttctggtccagctgttttgtttttgcacggtttcccagaattatggtattcctggagacaccaattgttgtacttgtcttctttgggttacagagctattgctccagatttgagaggtttcggtgacaccgatgctccaccatctccatcctcctacaccgcccaccacatcgttggtgatttggtcggtttgttggatcaattaggtgtcgatcaagtctttttggttggtcatgattggggtgctatgatggcctggtacttctgtttgttccgtccagacagagtcaaggccttagttaatttatctgtccacttcaccccacgtaacccagctatctctccattagatggtttccgtttgatgttgggtgatgatttctacgtttgtaagtttcaagaaccaggtgtcgctgaagccgatttcggttctgttgatactgccactatgtttaaaaagttcttgaccatgagagatccacgtccacctattattccaaacggtttcagatccttggccaccccagaagctttgccatcctggttgactgaagaggatatcgattactttgctgccaaattcgctaagactggttttactggtggtttcaactactacagagctatcgacttgacctgggagttgactgctccatggtccggttctgaaatcaaggttccaactaagtttattgttggtgacttagacttggtttaccatttcccaggtgttaaggaatacattcacggtggtggtttcaagaaggacgttccattcttggaagaagttgtcgtcatggaaggtgctgctcattttatcaaccaagaaaaagctgacgaaattaattctttgatctatgacttcattaaacaattctag

SEQ ID NO: 122 - DNA, 951 bp, Artificial Sequence
  Synthetic Polynucleotide
atggaaaacatcgaacacaccactgtccaaactaacggtatcaagatgcacgtcgctgctattggtactggtccaccagttttgttgttgcatggtttcccagaattgtggtattcttggagacaccaattgttgtacttgtcttctgctggttacagagctatcgctccagacttgagaggttacggtgataccgacgctccaccttccccatcttcctataccgctttacacattgtcggtgatttggtcggtttgttggacgtcttgggtatcgaaaaagtcttcttaatcggtcacgactggggtgccatcatcgcctggtacttctgtttattcagacctgatagaatcaaagctttggttaacttgtctgttcaattcttcccaagaaacccaaccaccccatttgttaagggtttcagagccgtcttgggtgatcaattttacatggttagattccaagaaccaggtaaagctgaagaagaattcgcttccgttgatattagagaattcttcaagaatgttttgtccaacagagatccacaagctccatatttgccaaatgaagttaagttcgaaggtgtcccaccaccagctttggctccatggttgaccccagaagatatcgatgtctacgctgacaaattcgctgaaactggtttcactggtggtttgaactactacagagcctttgacagaacctgggaattaactgctccatggaccggtgcccgtattggtgtcccagtcaagttcattgtcggtgatttggacttgacttaccactttccaggtgctcaaaaatacattcacggtgaaggtttcaagaaggctgtcccaggtttggaagaagttgtcgttatggaggatacctctcacttcattaaccaagaaagaccacacgaaattaattctcacatccacgatttcttctctaagttctgttaa

SEQ ID NO: 123 - DNA, 951 bp, Artificial Sequence
  Synthetic Polynucleotide
atggatcaaattgaacacatcactattaacaccaacggtatcaaaatgcatatcgcctctgttggtactggtcctgttgttttgttgttgcatggtttcccagaattgtggtactcttggcgtcatcaattgttgtatttgtcctctgtcggttacagagctattgctccagatttaagaggttacggtgatactgactctccagcctctccaacttcttataccgctttgcatatcgttggtgacttggtcggtgctttggatgaattgggtattgaaaaggtcttcttggtcggtcatgattgggctgccatcatcgcttggtacttttgtttgtttagaccagatcgtattaaagctttagttaatttgtctgttcaattcatcccaagaaacccagctatcccatttattgaaggtttcagaaccgcttttggtgatgatttctacatgtgtagattccaagttccaggtgaagctgaagaagactttgcttctattgatactgctcaattgttcaaaacctccttgtgtaacagatcctccgctccaccatgcttgccaaaagaaatcggtttcagagctattccaccaccagaaaatttgccatcttggttgaccgaggaagacattaattactacgctgctaagttcaagcaaaccggtttcactggtgctttaaactactatagagctttcgatttgacctgggaattaactgctccatggaccggtgctcaaattcaagtcccagtcaagttcattgttggtgattctgacttgacttaccattttccaggtgctaaggaatacatccacaacggtggtttcaagaaggacgttccattgttggaagaagttgttgttgtcaaggacgcttgtcacttcatcaaccaagaaagaccacaagaaattaacgctcacattcatgactttattaacaagttctaa

SEQ ID NO: 124 - DNA, 942 bp, Artificial Sequence
  Synthetic Polynucleotide
atggagaagatcgaacactcaacgattgccaccaacggaataaatatgcatgtggcgagcgcaggtagtgggccagctgttcttttcctgcatggttttcctgaattgtggtactcttggagacatcaactattatatctctcctcgttaggatatcgcgctattgcaccggatttgaggggctttggtgacacagatgcccccccatctccttcatcttacactgctcaccacatagtaggcgacctggtcggtttgttagatcagctaggagtagatcaagttttcctagtcggtgactggggagcgatgatggcttggtatttttgcttatttagacctgatcgggttaaagctcttgtgaatttgagtgtgcatttcacaccacgtaacccagcaatttcccctttggatggctttcgacttatgttaggggatgacttctacgtatgtaaattccaagagccaggtgttgccgaagcagattttggttcggttgacactgctaccatgttcaagaaatttttgacgatgagagatccgaggcccccaatcattcccaatggttttagaagtcttgcgacacccgaagcactcccttcttggttaactgaagaggatatagactattttgccgcaaagttcgctaagaccggtttcacgggcgggtttaattactatagagccattgatctaacatgggaattaactgccccttggtcaggaagcgaaatcaaagtcccgactaaatttatagtaggggacctggatctcgtttatcatttcccaggtgtcaaagaatatattcatggaggaggttttaaaaaggacgttccatttttggaggaagttgtcgtaatggaaggtgctgctcactttataaaccaggagaaggcagatgagatcaactcattgatctacgattttattaaacaattctaa

SEQ ID NO: 125 - DNA, 951 bp, Artificial Sequence
  Synthetic Polynucleotide
atggagaagatcgaacacaccacgatttcaacaaacggaataaatatgcatgtggcgagcattggtagtgggccagccgttcttttcctgcatggttttcctgaattgtggtactcttggagacatcaactattatttctctcctcgatgggatatcgcgctatcgcaccggatttgaggggcttcggtgacactgatgctcccccatctccttcatcttatacagcacaccacatagtaggcgacctagtcggtttattagatcagctgggaattgatcaagttttcctcgtaggtcatgactggggcgccatgatggcttggtacttttgcttgtttcgtccagatagagttaaagcgttagttaatttgtccgtccatttcttacggcgacatcctagtattaaatttgtcgatgggtttagagcactactaggtgacgatttttatttctgtcaatttcaggaaccaggcgtggctgaagccgactttggttctgtggatgttgctactatgttgaagaaattccttaccatgagagatccacgtccccccatgatacctaaggagaaaggcttcagggcattagaaactcctgatccactcccagcctggttgacagaggaagatatagactatttcgcgggaaagtttagaaaaactggatttaccggtggtttcaactactatagagcttttaatcttacgtgggaacttacagcaccgtggtctggttcggaaatcaaggtagctgcaaaatttattgtgggagatcttgatctcgtttaccacttcccgggcgccaaagaatacattcatggaggtggctttaaaaaagacgttcccttattggaagaggtcgtagtggtcgatggggccgctcacttcataaaccaagagaggcctgctgagatttcttcacttatctatgacttcatcaagaagttttaa

SEQ ID NO: 126 - DNA, 1587 bp, Artificial Sequence
  Synthetic Polynucleotide
atggtggaccaatgtgcacttgggtggatcctagcgtcagctctgggcttagtaatagccctctgcttctttgtcgctcctcgaagaaaccaccgcggagttgattcgaaagagagagatgaatgtgttcagtctgcggcaaccactaagggtgaatgtaggtttaatgaccgtgatgtagatgttattgtcgtgggtgctggtgttgccggatccgcattggcacatacgttgggcaaagacggtagaagggtgcatgtaattgaaagagacctcacagaaccagatcggatagttggggagttacttcaaccgggtggttacttaaagctaatcgagttaggattgcaagattgcgtggaagaaattgatgctcagagagtatatggctatgccttgttcaaagatggaaaaaatacacgtttgagctacccattagagaactttcacagtgacgtttctggtcgatcattccataatggtagatttattcaacgtatgagagaaaaggctgcgtccctacccaacgtcaggctggaacaaggaactgttacctcgctcttggaggaaaaaggcactatcaagggtgtccaatataaatcaaagaatggggaagaaaaaacagcatacgctccgctcactatagtgtgtgacggttgtttctctaacttacgccgaagtctgtgcaatcctatggtcgatgttccaagctattttgtaggcttggtgttggaaaattgcgagctgccattcgctaaccacggacatgtaattttaggcgatccttctcccattcttttttaccagatttccaggaccgaaataagatgtttggttgatgtccctggtcaaaaagttccatcaatagcaaatggcgagatggaaaagtatctgaaaacagtggtagctcctcaggttcctccacaaatctatgatagttttattgcggccatagacaagggtaacatcaggacgatgcccaatagatctatgccagctgccccacatcctacgccgggtgcccttctaatgggggatgcatttaacatgagacatcccctgacaggaggtggtatgaccgtggcattgagcgatattgtagttttacgtaatcttttaaaacctctcaaggacctgtcagatgcaagtactctgtgcaagtatttagaaagtttctacacccttagaaaaccagttgcttcaactattaacacgttggccggggctctatataaagtattttgtgcctctccggaccaggctaggaaagaaatgcgtcaagcttgtttcgattatttatccttgggaggcatattttcaaatggccctgtatcgctattaagcggactaaacccaagaccactatctctagtcctccacttctttgctgtggcaatatacggtgttggtcgcttgctacttccatttccttctgtcaaggggatctggattggagcgcgtttaatctatagcgcgagtggtattatttttcccattataagagctgagggtgttagacagatgtttttccctgcaacagttcctgcctactataggtccccacccgtgttcaaacccatagtttaa

SEQ ID NO: 127 - DNA, 1575 bp, Artificial Sequence
  Synthetic Polynucleotide
atggtggaccaatgtgcacttgggtggatcctagcgtcagttctgggcgctgccgcactctactttttgttcggacgaaaaaatggtggtgtatcgaacgaaaggcgccatgagtccataaagaatattgctactaccaacggtgaatataaaagctctaattccgatggggatattataatcgtcggcgcaggagttgctggtagtgccttagcttatacgttgggtaaggacggaagaagagtgcacgtcattgagcgtgatttgacagaaccggatagaatcgtgggggaattattgcagcccggcggttacttaaaactaactgagttaggtcttgaagactgcgttgatgatattgacgcacaaagggtatatggttacgctttatttaaggatggtaaagatacacggctatcttatccattagaaaagttccattcagacgtagccggaaggtcttttcacaacggcagattcatccaaagaatgcgggaaaaagcggctagtttgccaaaagtttcacttgagcagggtaccgtaacttcgctgcttgaagaaaatggcattataaagggcgtccaatacaaaacaaaaacaggtcaagaaatgaccgcctatgcacctctcactattgtttgtgacggatgcttttctaacctgcgtagatccttgtgtaatcctaaggttgatgtaccatcatgctttgtgggcttagttcttgagaactgtgatctaccctacgctaatcatgggcatgtgatactggctgaccctagtccaatattgttctatcgaatttcttcaacggagatcagatgtttagtcgacgttcccggacaaaaagttccttcgatctctaatggtgaaatggcgaattacctgaagaacgtagtcgccccacagataccaagtcagttgtatgatagctttgttgcagcaattgataaaggaaatattaggactatgccgaaccgtagcatgccggccgatccttatcccactccgggtgctttattgatgggtgacgcgtttaatatgagacacccattgacaggcggaggtatgaccgtcgcgctgagtgatgttgtcgtgctaagagacctattaaaaccattacgcgatttaaacgatgctcctacactgtcaaagtaccttgaagcattctacacgctacgaaaaccagtagccagtaccatcaacacattggctggtgcattgtataaggtgttttgcgcatctccagatcaagcacgtaaagaaatgagacaggcatgtttcgattatttgtctcttggtggtattttttccaatggacctgtatcactactctcagggttgaatccaaggccaattagcctagtactacatttctttgccgttgccatctacggcgtaggtcgtctattaataccgtttccttctcctaagagagtctggatcggcgctagaattataagcggcgcttcggcaattatcttccctataataaaggctgaaggagttagacaaatgttctttccggctactgtggcggcttattatcgtgcaccaagagttgtcaagggtaggtaa

SEQ ID NO: 128 - DNA, 1536 bp, Artificial Sequence
  Synthetic Polynucleotide
atggacggggtaattgatatgcagaccatacccctacgtacggccatcgcaattggaggcactgcggttgctcttgtcgtggctttgtacttctggtttctccgtagctatgcatctccttcccaccattcaaatcatttaccgcctgttccagaagtaccaggtgtgccagttttaggtaacctgttgcaattgaaagagaagaaaccctatatgacatttactaagtgggccgaaatgtacggtcctatctattcgattcgcacaggagctacatcaatggtcgttgtaagtagtaatgagatagcgaaagaagtggttgtgactaggttcccatctatctcaactagaaaactgtcctatgccttgaaggtcttaaccgaagataaatctatggtcgcaatgagcgattaccatgactaccacaaaacagttaagcgacatattttaacggctgttctaggcccaaacgcacaaaagaaatttagagctcacagagataccatgatggagaatgtaagcaacgaattgcatgctttctttgaaaagaatcctaatcaggaagtcaaccttagaaaaatatttcaatcccaacttttcggtttagctatgaaacaggcattagggaaggatgtggaatctatttatgtaaaggacctggaaactaccatgaaaagggaagagatattcgaagttcttgttgttgaccccatgatgggagccattgaagtcgattggcgagattttttcccgtatctcaaatgggtgccaaataaatcttttgaaaatataatccataggatgtacacgagaagagaggccgttatgaaagcgttgattcaagagcacaagaaaaggatcgcttcaggtgagaacctaaattcctacatagattatctcttgagtgaagctcaaacattaactgacaaacagttattaatgtcgttgtgggaacctattatagaatcgtctgatactaccatggtaacaacagaatgggcaatgtatgaacttgcgaagaaccctaatatgcaagatcgtctgtacgaagagattcaatcggtttgtggaagcgagaagattacagaagaaaacttatcacaactcccatatctatatgccgttttccaggaaactctgagaaagcattgccctgtgccgatcatgccacttagatacgtacatgagaacactgttttgggtggttaccacgtaccagcaggcaccgaagtggcaatcaatatttatggctgtaatatggacaagaaagtgtgggaaaatcccgaagagtggaatccagaacgttttctgtctgaaaaagagagtatggatttgtataaaacgatggcatttggtggaggtaaaagagtttgtgcgggatctctacaagctatggtaattagttgcatcggcatcgggaggttagttcaagattttgaatggaaactaaaagatgacgctgaagaagatgtgaatacattaggtttgactacgcaaaagctacaccctttgttagcactaattaacccgcggaaa

SEQ ID NO: 129 - protein, 520 aa, Siraitia grosvenorii
MEMSSSVAATISIWMVVVCIVGVGWRVVNWVWLRPKKLEKRLREQGLAGNSYRLLFGDLKERAAMEEQANSKPINFSHDIGPRVFPSMYKTIQNYGKNSYMWLGPYPRVHIMDPQQLKTVFTLVYDIQKPNLNPLIKFLLDGIVTHEGEKWAKHRKIINPAFHLEKLKDMIPAFFHSCNEIVNEWERLISKEGSCELDVMPYLQNLAADAISRTAFGSSYEEGKMIFQLLKELTDLVVKVAFGVYIPGWRFLPTKSNNKMKEINRKIKSLLLGIINKRQKAMEEGEAGQSDLLGILMESNSNEIQGEGNNKEDGMSIEDVIEECKVFYIGGQETTARLLIWTMILLSSHTEWQERARTEVLKVFGNKKPDFDGLSRLKVVTMILNEVLRLYPPASMLTRIIQKETRVGKLTLPAGVILIMPIILIHRDHDLWGEDANEFKPERFSKGVSKAAKVQPAFFPFGWGPRICMGQNFAMIEAKMALSLILQRFSFELSSSYVHAPTVVFTTQPQHGAHIVLRKL

SEQ ID NO: 130 - protein, 473 aa, Siraitia grosvenorii
MWTVVLGLATLFVAYYIHWINKWRDSKFNGVLPPGTMGLPLIGETIQLSRPSDSLDVHPFIQKKVERYGPIFKTCLAGRPVVVSADAEFNNYIMLQEGRAVEMWYLDTLSKFFGLDTEWLKALGLIHKYIRSITLNHFGAEALRERFLPFIEASSMEALHSWSTQPSVEVKNASALMVFRTSVNKMFGEDAKKLSGNIPGKFTKLLGGFLSLPLNFPGTTYHKCLKDMKEIQKKLREVVDDRLANVGPDVEDFLGQALKDKESEKFISEEFIIQLLFSISFASFESISTTLTLILKLLDEHPEVVKELEAEHEAIRKARADPDGPITWEEYKSMTFTLQVINETLRLGSVTPALLRKTVKDLQVKGYIIPEGWTIMLVTASRHRDPKVYKDPHIFNPWRWKDLDSITIQKNFMPFGGGLRHCAGAEYSKVYLCTFLHILCTKYRWTKLGGGRIARAHILSFEDGLHVKFTPKE

SEQ ID NO: 131 - protein, 701 aa, Siraitia grosvenorii
MKVSPFEFMSAIIKGRMDPSNSSFESTGEVASVIFENRELVAILTTSIAVMIGCFVVLMWRRAGSRKVKNVELPKPLIVHEPEPEVEDGKKKVSIFFGTQTGTAEGFAKALADEAKARYEKATFRVVDLDDYAADDDQYEEKLKNESFAVFLLATYGDGEPTDNAARFYKWFAEGKERGEWLQNLHYAVFGLGNRQYEHFNKIAKVADELLEAQGGNRLVKVGLGDDDQCIEDDFSAWRESLWPELDMLLRDEDDATTVTTPYTAAVLEYRVVFHDSADVAAEDKSWINANGHAVHDAQHPFRSNVVVRKELHTSASDRSCSHLEFNISGSALNYETGDHVGVYCENLTETVDEALNLLGLSPETYFSIYTDNEDGTPLGGSSLPPPFPSCTLRTALTRYADLLNSPKKSALLALAAHASNPVEADRLRYLASPAGKDEYAQSVIGSQKSLLEVMAEFPSAKPPLGVFFAAVAPRLQPRFYSISSSPRMAPSRIHVTCALVYDKMPTGRIHKGVCSTWMKNSVPMEKSHECSWAPIFVRQSNFKLPAESKVPIIMVGPGTGLAPFRGFLQERLALKESGVELGPSILFFGCRNRRMDYIYEDELNNFVETGALSELVIAFSREGPTKEYVQHKMAEKASDIWNLISEGAYLYVCGDAKGMAKDVHRTLHTIMQEQGSLDSSKAESMVKNLQMNGRYLRDVW

SEQ ID NO: 132 - protein, 692 aa, Siraitia grosvenorii [sequence omitted]

SEQ ID NO: 133 - protein, 316 aa, Siraitia grosvenorii
MDEIEHITINTNGIKMHIASVGTGPVVLLLHGFPELWYSWRHQLLYLSSVGYRAIAPDLRGYGDTDSPASPTSYTALHIVGDLVGALDELGIEKVFLVGHDWGAIIAWYFCLFRPDRIKALVNLSVQFIPRNPAIPFIEGFRTAFGDDFYICRFQVPGEAEEDFASIDTAQLFKTSLCNRSSAPPCLPKEIGFRAIPPPENLPSWLTEEDINFYAAKFKQTGFTGALNYYRAFDLTWELTAPWTGAQIQVPVKFIVGDSDLTYHFPGAKEYIHNGGFKRDVPLLEEVVVVKDACHFINQERPQEINAHIHDFINKF

SEQ ID NO: 134 - protein, 317 aa, Siraitia grosvenorii
MDAIEHRTVSVNGINMHVAEKGEGPVVLLLHGFPELWYSWRHQILALSSLGYRAVAPDLRGYGDTDAPGSISSYTCFHIVGDLVALVESLGMDRVFVVAHDWGAMIAWCLCLFRPEMVKAFVCLSVPFRQRNPKMKPVQSMRAFFGDDYYICRFQNPGEIEEEMAQVGAREVLRGILTSRRPGPPILPKGQAFRARPGASTALPSWLSEKDLSFFASKYDQKGFTGPLNYYRAMDLNWELTASWTGVQVKVPVKYIVGDVDMVFTTPGVKEYVNGGGFKKDVPFLQEVVIMEGVGHFINQEKPEEISSHIHDFISKF

SEQ ID NO: 135 - protein, 316 aa, Siraitia grosvenorii
MDQIEHITINTNGIKMHIASVGTGPVVLLLHGFPELWYSWRHQLLYLSSVGYRAIAPDLRGYGDTDSPASPTSYTALHIVGDLVGALDELGIEKVFLVGHDWGAIIAWYFCLFRPDRIKALVNLSVQFIPRNPAIPFIEGFRTAFGDDFYMCRFQVPGEAEEDFASIDTAQLFKTSLCNRSSAPPCLPKEIGFRAIPPPENLPSWLTEEDINYYAAKFKQTGFTGALNYYRAFDLTWELTAPWTGAQIQVPVKFIVGDSDLTYHFPGAKEYIHNGGFKKDVPLLEEVVVVKDACHFINQERPQEINAHIHDFINKF

SEQ ID NO: 136 - protein, 316 aa, Siraitia grosvenorii
MEKIEHTTISTNGINMHVASIGSGPAVLFLHGFPELWYSWRHQLLFLSSMGYRAIAPDLRGFGDTDAPPSPSSYTAHHIVGDLVGLLDQLGIDQVFLVGHDWGAMMAWYFCLFRPDRVKALVNLSVHFLRRHPSIKFVDGFRALLGDDFYFCQFQEPGVAEADFGSVDVATMLKKFLTMRDPRPPMIPKEKGFRALETPDPLPAWLTEEDIDYFAGKFRKTGFTGGFNYYRAFNLTWELTAPWSGSEIKVAAKFIVGDLDLVYHFPGAKEYIHGGGFKKDVPLLEEVVVVDGAAHFINQERPAEISSLIYDFIKKF

SEQ ID NO: 137 - protein, 314 aa, Siraitia grosvenorii
MEKIEHSTIATNGINMHVASAGSGPAVLFLHGFPELWYSWRHQLLYLSSLGYRAIAPDLRGFGDTDAPPSPSSYTAHHIVGDLVGLLDQLGVDQVFLVGHDWGAMMAWYFCLFRPDRVKALVNLSVHFTPRNPAISPLDGFRLMLGDDFYVCKFQEPGVAEADFGSVDTATMFKKFLTMRDPRPPIIPNGFRSLATPEALPSWLTEEDIDYFAAKFAKTGFTGGFNYYRAIDLTWELTAPWSGSEIKVPTKFIVGDLDLVYHFPGVKEYIHGGGFKKDVPFLEEVVVMEGAAHFINQEKADEINSLIYDFIKQF

SEQ ID NO: 138 - protein, 316 aa, Siraitia grosvenorii
MENIEHTTVQTNGIKMHVAAIGTGPPVLLLHGFPELWYSWRHQLLYLSSAGYRAIAPDLRGYGDTDAPPSPSSYTALHIVGDLVGLLDVLGIEKVFLIGHDWGAIIAWYFCLFRPDRIKALVNLSVQFFPRNPTTPFVKGFRAVLGDQFYMVRFQEPGKAEEEFASVDIREFFKNVLSNRDPQAPYLPNEVKFEGVPPPALAPWLTPEDIDVYADKFAETGFTGGLNYYRAFDRTWELTAPWTGARIGVPVKFIVGDLDLTYHFPGAQKYIHGEGFKKAVPGLEEVVVMEDTSHFINQERPHEINSHIHDFFSKFC

SEQ ID NO: 139 - protein, 316 aa, Siraitia grosvenorii
MDQIEHITINTNGIKMHIASVGTGPVVLLLHGFPELWYSWRHQLLYLSSVGYRAIAPDLRGYGDTDSPASPTSYTALHIVGDLVGALDELGIEKVFLVGHDWAAIIAWYFCLFRPDRIKALVNLSVQFIPRNPAIPFIEGFRTAFGDDFYMCRFQVPGEAEEDFASIDTAQLFKTSLCNRSSAPPCLPKEIGFRAIPPPENLPSWLTEEDINYYAAKFKQTGFTGALNYYRAFDLTWELTAPWTGAQIQVPVKFIVGDSDLTYHFPGAKEYIHNGGFKKDVPLLEEVVVVKDACHFINQERPQEINAHIHDFINKF

SEQ ID NO: 140 - protein, 313 aa, Siraitia grosvenorii
MEKIEHSTIATNGINMHVASAGSGPAVLFLHGFPELWYSWRHQLLYLSSLGYRAIAPDLRGFGDTDAPPSPSSYTAHHIVGDLVGLLDQLGVDQVFLVGDWGAMMAWYFCLFRPDRVKALVNLSVHFTPRNPAISPLDGFRLMLGDDFYVCKFQEPGVAEADFGSVDTATMFKKFLTMRDPRPPIIPNGFRSLATPEALPSWLTEEDIDYFAAKFAKTGFTGGFNYYRAIDLTWELTAPWSGSEIKVPTKFIVGDLDLVYHFPGVKEYIHGGGFKKDVPFLEEVVVMEGAAHFINQEKADEINSLIYDFIKQF

SEQ ID NO: 141 - protein, 316 aa, Siraitia grosvenorii; identical to SEQ ID NO: 136

SEQ ID NO: 142 - protein, 528 aa, Siraitia grosvenorii
MVDQCALGWILASALGLVIALCFFVAPRRNHRGVDSKERDECVQSAATTKGECRFNDRDVDVIVVGAGVAGSALAHTLGKDGRRVHVIERDLTEPDRIVGELLQPGGYLKLIELGLQDCVEEIDAQRVYGYALFKDGKNTRLSYPLENFHSDVSGRSFHNGRFIQRMREKAASLPNVRLEQGTVTSLLEEKGTIKGVQYKSKNGEEKTAYAPLTIVCDGCFSNLRRSLCNPMVDVPSYFVGLVLENCELPFANHGHVILGDPSPILFYQISRTEIRCLVDVPGQKVPSIANGEMEKYLKTVVAPQVPPQIYDSFIAAIDKGNIRTMPNRSMPAAPHPTPGALLMGDAFNMRHPLTGGGMTVALSDIVVLRNLLKPLKDLSDASTLCKYLESFYTLRKPVASTINTLAGALYKVFCASPDQARKEMRQACFDYLSLGGIFSNGPVSLLSGLNPRPLSLVLHFFAVAIYGVGRLLLPFPSVKGIWIGARLIYSASGIIFPIIRAEGVRQMFFPATVPAYYRSPPVFKPIV

SEQ ID NO: 143 - protein, 524 aa, Siraitia grosvenorii
MVDQCALGWILASVLGAAALYFLFGRKNGGVSNERRHESIKNIATTNGEYKSSNSDGDIIIVGAGVAGSALAYTLGKDGRRVHVIERDLTEPDRIVGELLQPGGYLKLTELGLEDCVDDIDAQRVYGYALFKDGKDTRLSYPLEKFHSDVAGRSFHNGRFIQRMREKAASLPKVSLEQGTVTSLLEENGIIKGVQYKTKTGQEMTAYAPLTIVCDGCFSNLRRSLCNPKVDVPSCFVGLVLENCDLPYANHGHVILADPSPILFYRISSTEIRCLVDVPGQKVPSISNGEMANYLKNVVAPQIPSQLYDSFVAAIDKGNIRTMPNRSMPADPYPTPGALLMGDAFNMRHPLTGGGMTVALSDVVVLRDLLKPLRDLNDAPTLSKYLEAFYTLRKPVASTINTLAGALYKVFCASPDQARKEMRQACFDYLSLGGIFSNGPVSLLSGLNPRPISLVLHFFAVAIYGVGRLLIPFPSPKRVWIGARIISGASAIIFPIIKAEGVRQMFFPATVAAYYRAPRVVKGR

SEQ ID NO: 144 - protein, 512 aa, Lactuca sativa
MDGVIDMQTIPLRTAIAIGGTAVALVVALYFWFLRSYASPSHHSNHLPPVPEVPGVPVLGNLLQLKEKKPYMTFTKWAEMYGPIYSIRTGATSMVVVSSNEIAKEVVVTRFPSISTRKLSYALKVLTEDKSMVAMSDYHDYHKTVKRHILTAVLGPNAQKKFRAHRDTMMENVSNELHAFFEKNPNQEVNLRKIFQSQLFGLAMKQALGKDVESIYVKDLETTMKREEIFEVLVVDPMMGAIEVDWRDFFPYLKWVPNKSFENIIHRMYTRREAVMKALIQEHKKRIASGENLNSYIDYLLSEAQTLTDKQLLMSLWEPIIESSDTTMVTTEWAMYELAKNPNMQDRLYEEIQSVCGSEKITEENLSQLPYLYAVFQETLRKHCPVPIMPLRYVHENTVLGGYHVPAGTEVAINIYGCNMDKKVWENPEEWNPERFLSEKESMDLYKTMAFGGGKRVCAGSLQAMVISCIGIGRLVQDFEWKLKDDAEEDVNTLGLTTQKLHPLLALINPRK

SEQ ID NO: 145 - protein, 9 aa, Artificial Sequence
  Synthetic Polypeptide
MDAQRGHTT

SEQ ID NO: 146 - protein, 5 aa, Artificial Sequence
  Synthetic Polypeptide
TILMF

SEQ ID NO: 147 - protein, 4 aa, Artificial Sequence
  Synthetic Polypeptide
PWLG

SEQ ID NO: 148 - protein, 16 aa, Artificial Sequence
  Synthetic Polypeptide
YGHLSAFLELAKSLSR

SEQ ID NO: 149 - protein, 3 aa, Artificial Sequence
  Synthetic Polypeptide
RNF

SEQ ID NO: 150 - protein, 4 aa, Artificial Sequence
  Synthetic Polypeptide
HIYF

SEQ ID NO: 151 - protein, 3 aa, Artificial Sequence
  Synthetic Polypeptide
CST

SEQ ID NO: 152 - protein, 6 aa, Artificial Sequence
  Synthetic Polypeptide
SVNLDA

SEQ ID NO: 153 - protein, 11 aa, Artificial Sequence
  Synthetic Polypeptide
IKPKLPSSSSS

SEQ ID NO: 154 - protein, 4 aa, Artificial Sequence
  Synthetic Polypeptide
DSIQ

SEQ ID NO: 155 - protein, 23 aa, Artificial Sequence
  Synthetic Polypeptide
LVELCLPSSPDQLPPHLHTTNAL

SEQ ID NO: 156 - protein, 21 aa, Artificial Sequence
  Synthetic Polypeptide
PPHLMPTLHQAFSMAAQHFAA

SEQ ID NO: 157 - protein, 8 aa, Artificial Sequence
  Synthetic Polypeptide
ILHTLAPH

SEQ ID NO: 158 - protein, 5 aa, Artificial Sequence
  Synthetic Polypeptide
LLIYD

SEQ ID NO: 159 - protein, 4 aa, Artificial Sequence
  Synthetic Polypeptide
SFQP

SEQ ID NO: 160 - protein, 9 aa, Artificial Sequence
  Synthetic Polypeptide
WAPQLASSL

SEQ ID NO: 161 - protein, 3 aa, Artificial Sequence
  Synthetic Polypeptide
NIP

SEQ ID NO: 162 - protein, 5 aa, Artificial Sequence
  Synthetic Polypeptide
AINFN

SEQ ID NO: 163 - protein, 3 aa, Artificial Sequence
  Synthetic Polypeptide
TTG

SEQ ID NO: 164 - protein, 12 aa, Artificial Sequence
  Synthetic Polypeptide
ASVLTRMLHATH

SEQ ID NO: 165 - protein, 21 aa, Artificial Sequence
  Synthetic Polypeptide
YPSSKFPISEFVLHDYWKAMY

SEQ ID NO: 166 - protein, 4 aa, Artificial Sequence
  Synthetic Polypeptide
SAAG

SEQ ID NO: 167 - protein, 6 aa, Artificial Sequence
  Synthetic Polypeptide
GAVTKK

SEQ ID NO: 168 - protein, 15 aa, Artificial Sequence
  Synthetic Polypeptide
DHKIGETLANCLHAS

SEQ ID NO: 169 - protein, 2 aa, Artificial Sequence
  Synthetic Polypeptide
CS

SEQ ID NO: 170 - protein, 4 aa, Artificial Sequence
  Synthetic Polypeptide
VILI

SEQ ID NO: 171 - protein, 7 aa, Artificial Sequence
  Synthetic Polypeptide
NSFRELE

SEQ ID NO: 172 - protein, 10 aa, Artificial Sequence
  Synthetic Polypeptide
EKYMDYLSVL

SEQ ID NO: 173 - protein, 2 aa, Artificial Sequence
  Synthetic Polypeptide
LN

SEQ ID NO: 174 - protein, 3 aa, Artificial Sequence
  Synthetic Polypeptide
KKV

SEQ ID NO: 175 - protein, 20 aa, Artificial Sequence
  Synthetic Polypeptide
VPVGPLVYEPNQDGEDEGYS

SEQ ID NO: 176 - protein, 9 aa, Artificial Sequence
  Synthetic Polypeptide
SIKNWLDKK

SEQ ID NO: 177 - protein, 4 aa, Artificial Sequence
  Synthetic Polypeptide
EPSS

SEQ ID NO: 178 - protein, 5 aa, Artificial Sequence
  Synthetic Polypeptide
TVFVS

SEQ ID NO: 179 - protein, 8 aa, Artificial Sequence
  Synthetic Polypeptide
FGSEYFPS

SEQ ID NO: 180 - protein, 14 aa, Artificial Sequence
  Synthetic Polypeptide
KEEMEEIAHGLEAS

SEQ ID NO: 181 - protein, 3 aa, Artificial Sequence
  Synthetic Polypeptide
EVH

SEQ ID NO: 182 - protein, 5 aa, Artificial Sequence
  Synthetic Polypeptide
FIWVV

SEQ ID NO: 183 - protein, 7 aa, Artificial Sequence
  Synthetic Polypeptide
RFPQGDN

SEQ ID NO: 184 - protein, 11 aa, Artificial Sequence
  Synthetic Polypeptide
TSAIEDALPKG

SEQ ID NO: 185 - protein, 5 aa, Artificial Sequence
  Synthetic Polypeptide
FLERV

SEQ ID NO: 186 - protein, 4 aa, Artificial Sequence
  Synthetic Polypeptide
GERG

SEQ ID NO: 187 - protein, 4 aa, Artificial Sequence
  Synthetic Polypeptide
MVVK

SEQ ID NO: 188 - protein, 4 aa, Artificial Sequence
  Synthetic Polypeptide
GWAP

SEQ ID NO: 189 - protein, 6 aa, Artificial Sequence
  Synthetic Polypeptide
QAKILK

SEQ ID NO: 190 - protein, 5 aa, Artificial Sequence
  Synthetic Polypeptide
HWSTG

SEQ ID NO: 191 - protein, 4 aa, Artificial Sequence
  Synthetic Polypeptide
GFVS

SEQ ID NO: 192 - protein, 3 aa, Artificial Sequence
  Synthetic Polypeptide
HCG

SEQ ID NO: 193 - protein, 10 aa, Artificial Sequence
  Synthetic Polypeptide
WNSVMESMMF

SEQ ID NO: 194 - protein, 3 aa, Artificial Sequence
  Synthetic Polypeptide
GVP

SEQ ID NO: 195 - protein, 4 aa, Artificial Sequence
  Synthetic Polypeptide
IIGV

SEQ ID NO: 196 - protein, 4 aa, Artificial Sequence
  Synthetic Polypeptide
PMHL

SEQ ID NO: 197 - protein, 12 aa, Artificial Sequence
  Synthetic Polypeptide
DQPFNAGLAEEA

SEQ ID NO: 198 - protein, 2 aa, Artificial Sequence
  Synthetic Polypeptide
GV

SEQ ID NO: 199 - protein, 3 aa, Artificial Sequence
  Synthetic Polypeptide
GVE

SEQ ID NO: 200 - protein, 10 aa, Artificial Sequence
  Synthetic Polypeptide
AKRDPDGKIQ

SEQ ID NO: 201 - protein, 13 aa, Artificial Sequence
  Synthetic Polypeptide
RDEVAKLIKEVVV

SEQ ID NO: 202 - protein, 1 aa, Artificial Sequence
  Synthetic Polypeptide
E

SEQ ID NO: 203 - protein, 21 aa, Artificial Sequence
  Synthetic Polypeptide
KTREDVRKKAREMSEILRSKG

SEQ ID NO: 204 - protein, 4 aa, Artificial Sequence
  Synthetic Polypeptide
EEKM

SEQ ID NO: 205 - protein, 11 aa, Artificial Sequence
  Synthetic Polypeptide
DEMVAAISLFL

SEQ ID NO: 206 - protein, 2 aa, Artificial Sequence
  Synthetic Polypeptide
KI

SEQ ID NO: 207 - DNA, 1371 bp, Artificial Sequence
  Synthetic Polynucleotide
atgaaccaagatggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagataggttctggagacgcgcaacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccataa

SEQ ID NO: 208 - DNA, 1362 bp, Artificial Sequence
  Synthetic Polynucleotide
atgaaccaagatggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagataggttctggacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccataa

SEQ ID NO: 209 - DNA, 1362 bp, Artificial Sequence
  Synthetic Polynucleotide
atgcaagatggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagatagacgcgcaacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaactaa

SEQ ID NO: 210 - DNA, 1371 bp, Artificial Sequence
  Synthetic Polynucleotide
atgcaagatggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagataggttctggagacgcgcaacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaactaa

SEQ ID NO: 211 - DNA, 1353 bp, Artificial Sequence
  Synthetic Polynucleotide
atgcaagatggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagatacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaactaa

SEQ ID NO: 212 - DNA, 1362 bp, Artificial Sequence
  Synthetic Polynucleotide
atgcaagatggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagataggttctggacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaactaa

SEQ ID NO: 213 - DNA, 1371 bp, Artificial Sequence
  Synthetic Polynucleotide
atggaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagataggttctggagacgcgcaacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaagatggctaa

SEQ ID NO: 214 - DNA, 1353 bp, Artificial Sequence
  Synthetic Polynucleotide
atggaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagatacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaagatggctaa

SEQ ID NO: 215 - DNA, 1362 bp, Artificial Sequence
  Synthetic Polynucleotide
atggaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagataggttctggacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaagatggctaa

SEQ ID NO: 216 - DNA, 1362 bp, Artificial Sequence
  Synthetic Polynucleotide
atggacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagatagacgcgcaacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaagatggcgaataa

SEQ ID NO: 217 - DNA, 1371 bp, Artificial Sequence
  Synthetic Polynucleotide
atggacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagataggttctggagacgcgcaacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaagatggcgaataa

SEQ ID NO: 218 - DNA, 1353 bp, Artificial Sequence
  Synthetic Polynucleotide
atggacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagatacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaagatggcgaataa

SEQ ID NO: 219 - DNA, 1362 bp, Artificial Sequence
  Synthetic Polynucleotide
atggatggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagatagacgcgcaacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaataa

SEQ ID NO: 220 - DNA, 1371 bp, Artificial Sequence
  Synthetic Polynucleotide
atggatggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagataggttctggagacgcgcaacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaataa

SEQ ID NO: 221 - DNA, 1353 bp, Artificial Sequence
  Synthetic Polynucleotide
atggatggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagatacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaataa

SEQ ID NO: 222 - DNA, 1362 bp, Artificial Sequence
  Synthetic Polynucleotide
atgggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagatagacgcgcaacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaagattaa

SEQ ID NO: 223 - DNA, 1353 bp, Artificial Sequence
  Synthetic Polynucleotide
atgggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagatacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaagattaa

SEQ ID NO: 224 - DNA, 1362 bp, Artificial Sequence
  Synthetic Polynucleotide
atgggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagataggttctggacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaagattaa

SEQ ID NO: 225 - protein, 456 aa, Artificial Sequence
  Synthetic Polypeptide
MNQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIGSGDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEP

SEQ ID NO: 226 - protein, 453 aa, Artificial Sequence
  Synthetic Polypeptide
MNQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIGSGRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEP

SEQ ID NO: 227 - protein, 453 aa, Artificial Sequence
  Synthetic Polypeptide
MQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPN

SEQ ID NO: 228 - protein, 456 aa, Artificial Sequence
  Synthetic Polypeptide
MQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIGSGDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPN

SEQ ID NO: 229 - protein, 450 aa, Artificial Sequence
  Synthetic Polypeptide
MQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPN

SEQ ID NO: 230 - protein, 453 aa, Artificial Sequence
  Synthetic Polypeptide
MQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIGSGRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPN

SEQ ID NO: 231 - protein, 456 aa, Artificial Sequence
  Synthetic Polypeptide
MEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIGSGDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDG

SEQ ID NO: 232 - protein, 450 aa, Artificial Sequence
  Synthetic Polypeptide
MEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDG

SEQ ID NO: 233 - protein, 453 aa, Artificial Sequence
  Synthetic Polypeptide
MEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIGSGRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDG

SEQ ID NO: 234 - protein, 453 aa, Artificial Sequence
  Synthetic Polypeptide
MDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDGE

SEQ ID NO: 235 - protein, 456 aa, Artificial Sequence
  Synthetic Polypeptide
MDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIGSGDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDGE

SEQ ID NO: 236 - protein, 450 aa, Artificial Sequence
  Synthetic Polypeptide
MDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDGE

SEQ ID NO: 237 - protein, 453 aa, Artificial Sequence
  Synthetic Polypeptide
MDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQ

SEQ ID NO: 238 - protein, 456 aa, Artificial Sequence
  Synthetic Polypeptide
MDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIGSGDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQ

SEQ ID NO: 239 - protein, 450 aa, Artificial Sequence
  Synthetic Polypeptide
MDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQ

SEQ ID NO: 240 - protein, 453 aa, Artificial Sequence
  Synthetic Polypeptide
MGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQD

SEQ ID NO: 241 - protein, 450 aa, Artificial Sequence
  Synthetic Polypeptide
MGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQD

SEQ ID NO: 242 - protein, 453 aa, Artificial Sequence
  Synthetic Polypeptide
MGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIGSGRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQD

SEQ ID NO: 243 - DNA, 1329 bp, Artificial Sequence
  Synthetic Polynucleotide
atggataatcagaacggaaggatttcaatagccctccttccgttcttagcacatggccacatctccccattttttgaattggctaagcaactggcgaaaagaaattgtaacgtgttcctatgcagtactcctattaatttaagctctatcaaagacaaggattcatcggcttctataaaattggtagagttgcatttacccagcagtccagacctgcctccacattatcacaccacaaacggtctaccctctcatttgatgcttcctttacgtaatgcatttgaaacggccggtccaacattctcagaaattctaaaaactcttaatccggatctcctaatttacgattttaacccttcctgggctccagagatagcctctagccacaacatccccgcggtttattttttaaccacagctgctgcaagttcgtccattgggctgcatgcattcaagaatccaggtgaaaaataccccttccctgacttttatgataattcaaatattactccagagccgccgagtgcagacaatatgaagttgctacacgatttcatagcatgttttgaaagatcctgcgatataatcttaattaagagttttagagaattggaaggaaaatacattgatcttctttctacgttatcggacaaaaccctggtccccgttggcccattggtacaagatcctatgggtcataacgaagacccaaagactgagcaaataattaactggttagataaacgagctgaatctacagtcgtgttcgtttgttttgggtcagaatattttctttctaatgaggaactagaagaagttgctatcggactcgagattagcacggttaactttatctgggcggtccgtttgatagaaggtgaaaagaaaggcattctacccgaaggttttgtacagcgcgtgggggatagaggtttggttgtcgaaggttgggctccacaagctaggattttaggccattcatcgactggaggctttgtttcccactgtggttggtcctcaatcgccgaatcgatgaaattcggagtgcctgtaatcgcaatggccagacatttagatcaaccgttgaacggtaagcttgcagctgaagtgggggtcggaatggaggttgtacgggacgagaatggtaaatataagcgcgagggtattgccgaagtgataaggaaagttgttgtcgagaaatctggagaggtaattcgtcgaaaagcgagagaactttctgagaagatgaaggaaaaaggtgaacaggaaatagacagagcactcgaggaactcgtacaaatctgcaaaaaaaagaaggatgagcagtaa

SEQ ID NO: 244 - DNA, 1359 bp, Artificial Sequence
  Synthetic Polynucleotide
atggctatggacacccatcaggccagcacgcctactacaactaccatcttgatgttcccatggctagggtatggacacttatcaccgtaccttgagctcgcaaaggcgctgtccacaagaaaaaattttttaatttatttctgttcgactccagtaaacttggatagtataaaacccaagctaattccatctccttcgatacaattggtcgaattacatttaccgtcctctcctgatttgccaccccaccttcatacaactaatgctcttccaccccacctaacgcctgtgttataccaagcatttgccgctgcggccccactgtttgaaacaattctcaaaaccttgtctccacatttgctaatctatgattgcttccaaccttgggctcctcgattagcatcaagccttaacatccctgcgattcattttaatacgagtagtgcagctattatatcattttctttccatgctactcataggccaggctcgaagtttccgtttagtgactttgttttacacaaccattggaaaagtaaagttgattctaatccatcagagcagattcgtatagtcacagaatccttcttcgaatgtttgaataaatcaagagatgtgatacttattaactcttttaaggaagttgagggtgaacatatggactatatcttcttactatcgaagaaaaaggtcattccggtaggtccattggtttacgaaccttctgaaaatgacgaggaagatgaggattacagtagaataaaaaactggttagacaaaaaggaagccttatcaactgttctagcttccatgggttcagaatcctatgcaagcgaagaagagaaggaggaaattgtgcaaggtctggtagagagcgaagcaaatttcatatgggtagaacggatcaacaaaaagggcgatgaggaacaacagattcgtcgcagagaacttttggagaaatctggagaaagagcgatggtagttgaaggatgggctccacaagggaagattcaaaaacacggctctatcggtggctttgtgtcacactgcggttggaatagcgtattggaaagtatcgtttctggtgtccctattataggtgttcctgtctttggggatcaacccattaatgctggagtggttgaggaggccggcattggtgtcgaagccaagagggatccagacggaaagatccaaaggaaagaaatagctagactaataaaagaggtggtaatcgaaaaaagtagggaagaattacgcatgaaggttagagaaatgagtgaagttgttaagcgaaaaggtgatgaaaaaattgaagagctcctgacccagatttcgcgtttctttaatatttcataa

SEQ ID NO: 245 - DNA, 1359 bp, Artificial Sequence
  Synthetic Polynucleotide
atggatgttcaaaagtctagggacacgcctacaactatcctaatgttgccctggattgggtatggccatctgtcagcataccttgagctcgccaaagtattgagtcgtcggaacaattttttaatatatttctgctcgaccccagtcaatttagattccattaaaccgcgattgataccaagctcatctattcagtttgtggaattacacctcccttcctctccagaatttcctccacatctacacactacaaacgctctgcctcccagacttacgccaaccttgcataaggcgttcgctgcggctgcatcacctttcgaagccatcttacaaacattgtgtccgcatctattaatatacgatagtctgcaacagtgggcaccacaaattgctagttccctgaatattcccgcaatcaactttaatactacagccgcttctataatcagccacgccttgcataatattaactatcctgacaccaaatttcccttatctgattgggttcttcacaattactggaagggtaaatatactacggccaatgaggcaactttggaaagaatcagacgcgttagagaatcctttctctattgtctttctgcctcaagggacataactttaattagcagttgccgtgagattgaaggtgaatacatggattacctttcagtgctactcaaaaagaaggtcatagcggtaggaccactggtttatgaaccgagagaggatgatgaggacgaagactattctaggattaaaaactggttggataaaaaggaagcattaagcacagttttagtctcgttcggttctgaattttttccaagtaaggaagaaatggaagagattggttgtggattggaagagtcaggtgctaatttcatctgggttattagaagccctaaaggcgaggaaaacaaaagagtagaagaggctctgcctgaggggttcgttgaaaaagcaggcgaaagagctatgatagtgaaggaatgggcgccacagggtaaaatccttaagcatcgatccataggaggatttgtcagccattgcggttggaactctgtgatggaaagtattatgctaggtgtacctgttatcgcggttccaatgcacgtcgatcaaccgtacaatgctggtctagtggaagaagcaggattaggcgtggaagccaaacgtgatccagacgggatgattcaaagagaggaggtagctaaattgatcagggaagtcgtggttgataaatctagggaagatctccggacaaaggttatagaaatgggagaaatattgagatcaaaaggggatgaaaaaattgacgaaatggttgctcaaatttcattactattgaagatttaa

SEQ ID NO: 246 - DNA, 1332 bp, Artificial Sequence
  Synthetic Polynucleotide
atggataatatgcaaaggccgatcaaagtacttatgttgccctggctcgcccatgggcacgtttccccttacctggagctagcaaagcgattatcgacgagaaacttccatatatatttgtgcagtaccccagtcaatctatcttctattaaacctaagattagcgaaaaatattcatctagcattgaattagtggaattacatttgccatcattaccggacctcccacctcactaccatactacaaagggacttcctccacaccttatgaacacattgaaagcggcttttgatatggcttcccccggttttggcgacatcgttacttcactaggtccggatctgttaatacatgagttcttgcagccatgggcagccgaagtggctaaaagtcacggtttaccaagtgtagttctgtttaatgtaggagcaggcactatatcctttatgttccatatgattaagaacacgggtaataagtttcctttcgaagcgattcgtttgcatgattatgaactagccaaaatccgcaaggcagctgacgattctacagctagagtcaatgagaaagatcgtgttctacaatcagtggaaagatcctctaacttcatactgttgaagacctttagggagatggacggtaaatacatggattatcttagctcattattaggaaaaaaggttttgacagtcggacccctggttgaagatccctctaatactgaagatggggattcgattatagaatggctggacaaaagagagaaatcctctactatcttcgtgtcatttggtaccgaatactttctaacagaaaaggaaagagaagagattgcacatggccttgagttatctaacgtaaattttatctgggtcattaggttctctgttgaagagagtgtcgaattaaaggaagcccttcccaaaggtttcttggaacgcgttcgggacagaggcctagtgatcgatgggtgggctcctcaaggtaaaatattagaacacccaagcattggaggttttgtgtcacattgtgggtggggcagcattatggagtcgatgaaatcaggtgttcctataatcgcaatgccaatgcagcacgaccaaccgttgaacgcgcgtatggtagaagaagttggtgtcgctatggaagtaaaaagaaataagtcaggagaattggagagactggagatagccaaggttattaaacatgtcgtagcagaaaaagacggtgatagcgttaggaagaaaactaaagagatgagtgattcaattagaaacaagggtgaggaagaactggacgaagtcgctgaggcattggttcaactctgttaa

SEQ ID NO: 247 - DNA, 1329 bp, Artificial Sequence
  Synthetic Polynucleotide
atggacaaccagaagggccgaatcagcattgcattgctaccattcttagcccatggacacataagtcctttttttgaacttgcgaaacaactggctaaaagaaattgcaatgttttcttatgttccaccccgattaacttgtcatctatcaaggataaagattcttcagcttcgattaagctcgtggagttgcatttaccatcgagtcccgatttgcctccacactaccatacgactaatgggctgcctagtcacctaatgcttccgttaaggaacgcatttgaaacagcaggtccaacattctctgaaatattgaaaaccttaaatccagaccttcttatctatgattttaatccctcctgggcccctgagattgcttcaagccataatatacctgccgtctattttctaactactgctgcggcttcttcctctattggtctgcatgcgtttaagaacccaggagaaaaatacccgttccccgacttctatgacaactccaatatcattccagagccaccttcagcagataatatgaagttattgcatgattttattgcttgttttgaaagatcatgcgatataatactcataaaatctttccgtgaattggaaggtaaatatattgatctactttcgacattatcggacaagacgctggttcctgtaggcccacttgtacaagatccgatgggtcacaatgaagatcccaagactgagcagatcatcaactggttggacaaacgcgccgagtccacagttgtgttcgtttgttttgggagcgaatactttttaagtaacgaagaactggaagaggtcgccattggtttagagatcagtaccgtcaatttcatttgggcagtaagactaatagaaggagaaaaaaaagggattttgcccgaaggttttgtgcaaagggttggagacagaggtctggtagtcgaaggctgggcgccccaagctcggatcctcggccatagctcaactggtggatttgtaagtcactgtggttggtcttccatcgcagaatcgatgaaattcggagttccagttattgctatggccagacacttggatcaacctctcaacggcaagttggctgctgaggtgggtgtgggaatggaagttgtccgtgatgagaatgggaagtacaagcgcgagggtatagcagaagtgataagaaaagttgtagttgagaaatctggggaagtaattaggcgtaaagcaagagaattatccgaaaaaatgaaggaaaaaggcgaacaggagattgacagagctgttgaagagctcgttcaaatatgcaaaaagaaaaaggatgagcaataa

SEQ ID NO: 248 - DNA, 1329 bp, Artificial Sequence
  Synthetic Polynucleotide
atggacaatcaaaaaggaagaattagtatagctctgctaccattcttagcacacggtcatatctctcctttttttgagcttgcgaagcagttggccaaacgcaactgtaatgtcttcctctgctcaacaccgattaacttgagctccatcaaggataaagattcgtctgctagcattaaattagtagaattacatttgccctcaagtccagacttacctccacattatcacaccacgaatggcctgccttctcatctaatgttgcccttaaggaatgcatttgaaacagccgggccaactttctcggaaatattaaagactcttaacccagatctattgatatacgattttaatcctagttgggcaccggaaattgcttcctcacacaacattcccgctgtgtattttcttacaactgcggcagcctcctctagtatcggtctacatgcgtttaagaatccaggagagaaataccccttcccggacttctatgataactcgaatattacccctgaaccaccgtctgctgataacatgaaactgcttcatgattttatagcctgttttgaacggtcatgtgacatcatcttgattaagtcgtttcgtgagcttgagggtaagtatatagatctcctatccaccttatcagacaaaacgctggttcctgttggcccattggtacaagatcctatgggtcacaatgaagatccaaagactgaacagatcataaattggctggataaacgagctgagtctacagtggttttcgtctgcttcggatccgaatacttcttaagcaacgaagaattggaagaggttgcaattggtttagaaattagtacagtaaactttatatgggcagttagactgattgaaggagaaaaaaaagggatcttgccagaaggttttgttcaaagagtaggcgatagaggtttagtggtcgaggggtgggctccacaagctagaattttaggacattcgagcactggtggctttgtatctcattgtggttggtcatccatagcagaatccatgaaattcggcgttcccgtgatcgcgatggcccgtcacctagaccagcctctaaatggcaaattggcagcggaagtcggtgttggtatggaggttgtcagggacgaaaatggcaagtacaagagagaagggattgctgaagttataagaaaagttgtagtggagaagtctggtgaagtaatcagaaggaaagctagagagctctccgagaaaatgaaagaaaagggagagcaagaaatagatagggccttagaagaattggtccaaatttgcaaaaaaaagaaggatgagcaataa

SEQ ID NO: 249 - DNA, 1347 bp, Artificial Sequence
  Synthetic Polynucleotide
atggatatcgaaaaaggtaggatatcgattgtaatgttgccattcctggcccacggacatattagccccttttttgagttagctaagcatctctccaaacgtaattgtaacatcttcctttgctctacccctataaatctatcaagtattaagaaccgagtctctgacaaagattcaagtgcatccatcaagttagtggaattgcatttgccatctagcccggacttacctccacactaccacacgacaaatggccttccgagtcatttaatggttcctctacgcaatgcgtttgagactgctgcacctactttctcagaaatacttaaaacattgaacccagatttattgatttatgattttaatcccagttgggccccggaaatcgcttcttcccataatattccagcagtatattttctgacatctgccgctgcaacctcgtcaatggggttgcacgcgtttaaaaactccggtgaaaagtacccattccctgacttctatgataatagcaatataactccagaacccccatcggcagataagatgaaactatttcatgattttgttgcttgtttcaaacggagttgcgatattatcttaataaaatcatttagagaactcgagggtaaatacattgacttcttgtctacactatcgaagaagactttggttcccgtgggacctttagtccaggaccctatgggtcacgacgaagatccaaaaactggccatttaattaactggctcgataagagagccgagtcaacggttgtgtttgtttgttttgggagtgagtattttcctagtaatgaagaactggaagagttagctattggtttggaaatctctatggtttctttcattctcgcggtaagattcccagaaggagagaagaaaggcattttaccagaaggttttgttcaaagggtcggcgaccgaggtctggtcgtagaggggtgggctcctcaagccagaatattaggtcattcttccaccggtggatttgtgtcccattgcggttggtcttcgattatggaatcagttaaatttggggtcccggtgatcgctatggcacgtcacttagatcaaccacttaacgctaaactagccgcagaagtaggagtcggtatggaagttatgagagatgaaaacggcaagtataaaagggaagccatagcagaagtaattaggaaagtcgtgatggagaaaaatggtgaagttatgagaagaaaggcaagagaactgagtgagaagatgaaagttaagggagagcaggagataggccgcgcagtagaagagctggtccaaatctgtaagaaaaagaagcagcatgcacaatactaa

SEQ ID NO: 250 - DNA, 1380 bp, Artificial Sequence
  Synthetic Polynucleotide
atgaccgaggtattcatgaatgccaagagtaaaaaactatccgtgctgatgtttccttggttggcgcacgggcatttatctccgtttctcgaactgggtcgcaagcttagcaaacgtaacttctcggttcatttgtgttcaacgccagctaatttatcttcaatcaggaaaagaatgggagaagagtctagtattcaattagtccagttggatctaccttcattgcccaacttaccaccatgctggcacactacaaatggtttgccaccgcatctaatggacacacttaagtccgcatttgatatggctaaacctggcttttccaagatattagaaactgttaaacccgaccttttaatttatgatttcttacggccttggcccgcacaagcagccgtagatctccgaatcccagccgtgcagttcatagctacctctgctactatgacgtcgtttatgttgcatacctttaaatacccatcaattgattatccgttctcgacaatattctacagagaatatgaaaaggctcaagtttccagaagtggtgaatgtgacgaacttcacaaagctattgagagcttggagatgtcggacactgtcatccttattaagggaattaaagaaatggaaggcaatttttctgattatctatcaacaatgagcggtaagaaaatagttcatgtgggagcactcgttcaagatcccatccgtaaagatgatagtgacattatccagtggttaaacaaaaagaaaaaatacagcacaatatttatctcttttggttctgaatactttctatccgaggaagattttaaggaattggcgcatggtctgatgctgtccaacgtaaatttcatttgggttgtcaggttcccagtaggcgagataattagagtggaagataagctacctgccggctttcataagaaagttggagcgagaggtctgatcgttgaagggtgggcaccacaagctaacattttgggtcacagctcaataggcgggttcgtcagtcattgtggttggaatagtgttaatgaatctatgtattttggagtacctatcatagccatgcctatgcaccttgatcaaccgattaatgcaagattagtaaaagactttggtactggaattgaggttttacgagatgaaaatgggagggtcaaaagagagaaaatagcatcagtaataaaacaagtcgtggctactcgcaacggcagaattatgcgaaagaaggccaaggagttaggtgcgtctatccgtcaaaaaggtgatgaagagattgatgaagtggttaaggaattgatgcaattatcgttattcaaaaaagctgaaattgaaattgacgaagttgtcagagagctgtcgaggccgtaa

SEQ ID NO: 251 - DNA, 1389 bp, Artificial Sequence
  Synthetic Polynucleotide
atggatagtaagcaaaaaaaaatgtctgtgctaatgttcccatggctcgcttacggtcatatttccccctttctggagttagcgaagaaactttcgaagcgtaactttcacaccttctttttctcaacaccgataaatttgaatagcatcaaaagtaagttgtctcctaaatatgcccagtcaattcaatttgttgaattacatctaccttctttgccagacttaccaccccactatcatacgactaacggactgcctccacacttaatgaatactcttaaaaaggcattcgatatgtccagcctacaatttagtaagatattaaaaacattgaacccagacctattggtctacgatttcattcagccatgggcacctcttttggctctttccaataaaatccccgccgttcattttttatgtacctcagctgcaatgtcaagtttttcagtccatgcttttaaaaagccgtgcgaagattttcctttcccaaacatatacgtacatgggaatttcatgaacgcgaaattcaataatatggagaactgttcttctgacgattcgatttcggatcaagacagggtattacaatgctttgaacgaagcacaaagatcattttggttaagactttcgaagaactagagggcaaatttatggattatttgagcgtgctattaaataaaaaaattgtgcctactggtcccctgacacaagatcctaatgaagacgaaggtgatgacgatgagagaactaagctcctactcgaatggcttaacaagaaatctaagtctagtacggttttcgtcagctttggatctgaatatttcctgtccaaagaagaaagagaggaaatagcctacggcttagaattgtccaaagttaattttatctgggtcattagatttccactgggggagaataaaacaaacttagaagaagcattaccgcagggtttcttacaacgcgtatccgagaggggtcttgtggtcgaaaactgggcaccacaggctaaaatcttgcagcattcatctataggtgggtttgtttcgcactgtggatggagttctgtaatggaatcactaaagttcggagttcctatcatagccatccccatgcatttggaccaaccacttaacgcacgtcttgttgtagatgtaggcgtcggcttagaggtcattagaaatcacggtagtttggaaagagaagagattgctaagctgattaaagaagttgttctaggtaatggcaatgatggtgaaatagttcgtagaaaagcgagggaaatgtcgaatcacataaagaaaaaaggggagaaggatatggatgagctagtggaagaactcatgttgatttgtaaaatgaagcccaattcctgccatctctcgtaa

SEQ ID NO: 252 - DNA, 1389 bp, Artificial Sequence
  Synthetic Polynucleotide
atggatgctaagcagaaaaaaatatcagtgttgatgtttccatggctggcctacggacacatttcccccttcctagagcttgcaaagaaattaagcaagagaaactttcatatcttcttttgttcgactcctattaatctcaataccattaaaccgaaattatctccaaagtatagtcaatctatagaatttgtcgacttccatttgcaatcactacctgatttacctccacattatcacacaacgaacggtttgccaccacacttaatgaatacacttaaaaaagcgttcgatatgtccagtctccatttttctaagatcttgaagactttaaatcccgatctattgatttacgactttatactgccctgggctcctctactggcacttagcaacaaaattcctgccgtacatttcttgtgcacgtctgcgacagttagctccttcttggttcatgctttaaaaaagccatgtgaagaagagtttccttttcccaaaatctattactgcttcttaaatgcaaaatttaacaataagatggaaaactgttcgggcgacgatggtatttcagatatagataggaccttacagagttttgaacgttccatgaagatcattctagtaaaaacttttgaagagttggaagggaaattcatggactatctcagtgtgttattaaataagaagatagtcccaactggcccgttgatccaagatccgaatgaagacgagggtgatgacgatgagcggactaaaattttccttgaatggctgaataagaagggaaaatcatctacagtttttgtatcgttcggttccgaatacttcttggacaaggaggaaagagaagaaatcgcctatgggctagagttgtctaaagttaactttatatgggttatccgctttccaataggagaaaacaaaactaatcttgatgaagctttgccccaaggtttcttgcagcgagttggcgagagaggtttagtggtggaaaattgggctccccaagcaaaaattctccaacactcaagtattggaggttttgtcagtcattgcggctggagctctgtaatggaatcacttaaattcggtgtaccaataattgcgattcctatgcatctcgaccagccactgaatgcaaggctggttgttgatgtcggagttggattggaagtcagaagaaaccatggttcactagaacgtgaggaaatcgccaagcttataaaagaggtcgtacttggcaatggtaacgatggggaaatcgttagacgtaaggctagggaaatgagcaatcacataaagaaaaaaggagaaaaagatatggacgaattagtcgaggaactaatgttaatttgtaagatgaaaccgaactcctgtcacttatcttaa

SEQ ID NO: 253 - DNA, 1332 bp, Artificial Sequence
  Synthetic Polynucleotide
atggaagccaaaaagaacactacccgcgtgcttatggtaccttggttggctcatggccacatatcaccatttttagagctagcaaaaaagctgacgaatagaaatttccatatttacatgtgctctacaccggttaacttgagttccatcaaaaagaatgtcacagaaaaatatagccaatctattgagttagttgaactccacctaccctcgttaccaaatttgcctccacattatcatactacaaacggattgcccccacatctgatgaacacccttaaaactgcgtttgaaatggctgcacctaagttctcaaaaatattagaaacgctcaatcccgaccttgtgatttacgattataatcagccttggacagcacaactagccttgtctatgaacatcccagctgtacaactattaaccttttcggcggccgtcgttgctctcgggattcacatgagtgaggataaggaagagaaatttccgttcccagaaatatacttgcgtgaatatgagatgttctccttaaagaaagctattaatgaatctcccggtaaggaatttccttttggtgaagcactaagaaggtccagagacatcgtattggttaaaacttgtagggattttgaaggtaaatacatggattatcttagtaacttagttacaaagaaaattgtaccagtgggaactctcgtccaggaatcaacggaccaagctgagcacgaagaaataatgcagtggctggataaaaaagagaaatcaagcactgttttcgtgtcatttggctcagaatatttcttatctaatgaagaaatcttggctgtcgcccaaggtttggagttatcgaaggttaatttcatttgggtaattcgatttccgcaaggtgaaagaatcagtatagcagatgcggtccctgaggtttttcttgagcgggtgggtgagagagggaaaatcctagaagaatgggccccacaggcgaatattttgcaacatccttcgacgggagggtttgtatctcattgtggctggtctagctttatggaaagtatgaagttcggtgttccaataatcgcaatgcccatgcatattgaccaacctatgaacgctcgtttggttgaatacataggcctgggagtcgaggcagttcgagatgaaaacgggaaattgcaatctgaagagattgctaaggcaataaggaaggtggtgatggaagaatccggtgaaccggtcagaaagaaagcgattgaattatctgagaaaatgaacgagaatggtgaagaagagatcgacggagttgtagaagaacttgtatcactgtgtggcaataaataa

SEQ ID NO: 254 - DNA, 1356 bp, Artificial Sequence
  Synthetic Polynucleotide
atggaaaaccaggagccgataagagcacttatgttcccctggttaggccatggtcacattagtccttttctggaattggcgaaaaagttagtaacccgtaatttcattatctacctatgcagcacaccagccaattttacgtccgtgaaacaaaagttgatcaacgaaaatttaactgagaaaatatatttggttgaactcaggcttccatctcttcctaacctaccaccccattatcatactacaaatggattacctccacacttgatgtcaacactaaagaaagcttttaagatgtcgagtccgatgttcactaaaattgtcaataccattaaacctgacttactgttgtacgatttattgcaaccttgggctccacgcgcagctttggaaaacaatatcccggcagttgtctttgttacatcttcaagcgtaatgttttctcatatgttccacacgttccggtatccatccagtaagtttccattcccaagcatatactatcgagattacgagattactagaatgctcgaaaatcaagatttggaacccattgaacagcaacaaaaagataacacctccgtgaagctatgttttggtaggtcttcaaacgttgtcctaatcaaagggtttaaagagatcgacggtaaatattcttcgtaccttagtagattaacaaaaaagaaaataatacctgtgggacccctggtacaggagcccacttcagaagacgataattctagccaaattttgacatggctgaatcaaaaagaaaagggttcgtcagtattcgtttcctttggctctgaatattttctaactaaagaagatagagaagagattgcccatggcttagagcagagcggtgtcaactttatatgggtcgtgagattcccgaagggtggaaagttaaaactagaacaagcgctgccagaggggttttttaagcgtgttggtgaacgtggcatggttgtcgaggactgggctcctcaagcaaaaatattaggtaatccaaacattggtggattcgtgtcccattgtggctggaatagtgttatggaaggaatgaaatttggcgttccgattattgccatgcctatgcatttggatcagccattgaacgctaggttagtagaagaggttggggttggtttggaagttgtaagaaataaagacggtaagctggatagagaacaaatcgctgctatgataaatagggtggttctggacatgagaggtgaagcggtgcgggaaaaggcaaaaaagatgtcagaaaccattagagttaaaggtgatgaggaaatcgatgtcgtggtacaagaattactcaaactttgtaagaggaatgtcgtctaa

SEQ ID NO: 255 - DNA, 1332 bp, Artificial Sequence
  Synthetic Polynucleotide
atggaggcgaagaaaaacaccattcgattgttaatggtcccatggctggctcacggtcatatctccccctttcttgaattagcaaaaaagctaacaaatcgcaatttccatatatatatgtactcaacgccggtaaacttgagctctattaaaaagaatgttactgaaaaatatagtcaatctatcgaactcgtggagttgcacttaccatcgcttcctaacctccctccacattaccatacaactaatgggctacctccccacttgatgaatacattaaaaaccgcctttgaaatggctgcaccaaagttcagcaagatactagaaactctgaacccagacttggttatttatgattacaaccagccatggacggcccaattagcattgtcaatgaatataccggctgtccaattattaacatttagtgcggctgtaattgctcttggcatccatatgtctgaagataaagaggaaaagtttcctttccccgagatttatctgagagaatatgaaatgctttcccttaaaaaagccataaatgagtcacccggaaaggaatttcctttcggtgaagcactaaggagaagccgtaacatcgttttggttaaaacctgccgggatttcgaaggtaaatacatggactacctcagtaatctagtgactaagaagattgtaccagtcggcactctcgtccaggaggctacagatcaagatgagcatgaagaaattatgcaatggcttgacaaaaaagaaaaatcttcaacagtttttgttagttttggatcggaatattttttgagtaatgaagagatcttagcagtggcgcagggtttggagttgtccaaggttaatttcatttgggtgattagatttccacaaggggagagaatatcaatagccgatgtagttcctgaagtcttcctggaaagggttggtaaatctggtaaaatattagaagaatgggccccccaagctaacattctccagcacccttccacgggcggatttgtctctcactgtggatggtcatccttcatggagtcgatgaagtttggtgtacctataattgctatgccaatgcatatcgaccaaccgatgaacgcaagattggtagagtatattggtttaggcgtcgaagcggtaagagatgaaaatggaaaacttcagtctgaagaaatcgctaaggcaatccggaaagttgtgatggaggaatctggagaaccagtccgtaagaaagcaagggaactaagcgagatgatgaatgagaaaggtgatgaagaaattgacggggttgtggaagagttggtttccctgtgtggtaacaagtaa

SEQ ID NO: 256 - DNA, 1380 bp, Artificial Sequence
  Synthetic Polynucleotide
atgaatgggttcatggacaaccaaaagcttctccgagtattaatgtttccatggctaggttacggacatatatctccctttctggagttggcaaaaaaattgtcacagagaaatttcaccatctatttatgtagtacacctgtgaacctaagctccattaagaaaaaattatctccggaattttcgccatcaattcaatttttggaactacacttgcagactcttagcaatctcccaccttgccatcacacgacaaacggcttaccccctcatttaatgaatactctgaaggaagctttcgatttggccagtccagatttcaccctgatcttaaaaactctaaagccggatttgctcatatatgactttcttcaaccttgggcgccaaaggctgctgccgaattgaaaattcccgcagtcgagttcatttcatccagttctacaatgacatcctacatgcttcacgtttttaataagccaggtatcaaatttccattctctagcatatattatagggattacgaaattgcacgcatagaaaaagacgagagttccatgcccatggaaaagttggaagaggataaaaagcgtgttagagattgtttttacttatcaagtgacattgtcttaatcaaatcgtttaaggaaatagaaggtaaatattccgattatgttacgaactctactggcaaaaaagtggtacctgttggaccactcgtgcaagagccgacccttgatgatggtgaatctgaactaattacatggctgaacgaaaaggaggagaaatctactatattcgtatcattcgggtcagaatattttctgagcaaagaagacttactcgaaatcgcgtgcggtctggaaaattcgaaagttaattttatttggccgataagatttcaaaaggagaaggatgtagaattacaggaagccttacctaaaggtttcttcaatagggttggtaaccgtggaaaagtctttaaaggctgggctcctcaagcaaaaattttggaacattcctcaattggcggatttgtgagtcattgtgggtggtcatctgtcatggagagcatgaaatacggtgtaccaatcatagctatgcctatgcatatcgatcagcccattaattccagattagtcgaagagattgggattgccgttgaagttgttcgggactctaacgccaagctacacagagaagtcgttgctgctataattaaccaagtagtggttgagaaggagggagagtttgtgagacaaaaggcaagggatatgcaagaaatcttgtgctcaaaaggagatgaagaaatcgaggaggttgcaaaagaattggaaaagctctgtgcgaaaaagacgcacagtttcattgagggcttctaa

SEQ ID NO: 257 - DNA, 1368 bp, Artificial Sequence
  Synthetic Polynucleotide
atggatgtacaaaaatccagagacactcccacgacaattctaatgttgccgtggataggttacgggcatctctctgcttatctggagcttgcgaaggtgttaagcaaacgcaataactttttgatctatttctgttcaacccctgtcaatctcgatagtattaagaggaaagttgttccatcttcgtcaagcatacagtttgtggaattacacctacctagttctccagaatttccaccccatttgcacactacaaacgccttgcctccacgtttaacccccactttacataaagcattcgctgcggctgcctcgcctttcgaagaaatccttcaaacgctgtgcccacaccttttgatttacgactccttacagccatgggcaccgcaaattgcatcatctttgaatattccagctataaactttaataccacagccgcgtccatcatttgtcatgcactacataatatcaattatccggatacaaagtttcctctgtcagattgggttttacataactattggaagggcaaatacacgacggctgaccctactaacagcgagagaattagacgagtacgggagagttttctgtactgcttatcagcatcgcacgatgtctcgctaataaattcttgtagggaaattgaaggagaatatatggattatttgagcgttttacttaagaaaaaggtcatagctgtgggtccattagcttatgaacccagagaggacgaagatgaggaagatgaagactactctcgtattaaaaattggctagataaaaaggaggttagtagtaccgtattggtatcgttcggatcagaatatttcccgtctaaacaagagatggaagacatcggtaacggcctagaagaatccggtgcaaattttatatgggtgatcagatttcccaagggtgaagaaaaccgcagagttgaggaagccttaccagaagggttcgtcgagaaagctggcgagagggccatgattctcaaggattgggctccgcaaggaaaaatattgaagcatcgttcaattggtggattcgttagtcattgcggttggaatagcgtcatggagtcaatcctgcttggcgtgcctgtcattggcgttccaatgcacgtagaccagccttacaatgcaggtttagttgaagaagctggactgggagttgaggccaaaagagatcctgacggtcgaatccaacgtgaagaagttgcgaaattgataagggaggtcgtagtcaacaagaatagagaagatttgcgtacaaaagttaaggaaatgtctgagattctgagatccaaaggtgatgaaaaaatcgaagagatggtggcgcaaatatccctacttctaaaaatttaa

SEQ ID NO: 258 - DNA, 1332 bp, Artificial Sequence
  Synthetic Polynucleotide
atggaagcaaaaaagaacaccattaggttgctaatggtaccatggctggcgcacggtcatatatctccttttcttgagttagccaaaaagttaactaatcgtaatttccatatctatatgtactccacgccggtcaacctcagctcaattaaaaagaatgttacagaaaaatatagtcaatcgatagagttggtggaattgcacttaccctctttgcctaatctacccccacattaccacacaactaacggacttccaccacatctcatgaacaccttaaagacagctttcgaaatggctgcacctaaattttcaaagattttagagactctcaatccggacttggttatctatgattacaatcagccgtggacagcccaattggctctttcgatgaacatccctgctgtgcagttgctgacgttttccgcagccgttattgcactagggatacatatgtctgaagataaagaagagaagttcccatttccagaaatatatttaagagaatatgaaatgctaagtttaaaaaaggccattaatgaaagccctggtaaagaatttccctttggcgaggctctaagacgatcaagaaatatcgtccttgtaaaaacctgtcgcgatttcgagggtaagtacatggactatctttctaatttagttactaaaaaaattgtacctgtcggaactttagttcaagaagctactgatcaagacgaacatgaagagataatgcaatggttggataaaaaggagaagagttcaacggtattcgtttctttcggcagcgaatactttttgtcaaatgaagagattctcgcagtggctcaaggtttggaactgtccaaagtgaactttatttgggtcataaggtttcctcagggggaaagaatctctattgcggatgttgtaccagaagtattcctagagagggttggtaaatccggcaaaattttggaagagtgggcaccacaagccaatattctgcaacacccaagcacaggaggttttgtgtcccattgcgggtggagctcatttatggagagtatgaagttcggtgtacctatcatagcaatgcccatgcatattgaccaacctatgaacgctcgtttagcagaatacattggactgggcgttgaagctgtgagagatgaaaacggtaaacttcagtcagaggaaattgctaaggccatcagaaaagtcgttatggaagagtccggagaacccgtccgcaagaaagcacgagaattatctgagatgatgaatgaaaaaggtgatgaagaaatagacggtgtggttgaggaactcgtcagtttatgtggcaacaaataa

SEQ ID NO: 259 - DNA, 1338 bp, Artificial Sequence
  Synthetic Polynucleotide
atggagggaaaaaagaatacgatttctatattgatgcttccgtggctcgctcatgggcacatcagccccttcctagaattagccaaacgtttgaccaaacgcaactttcatatttatatgtgttcgtccccagtgaatttaaacagtataaagaagtcagtcactgaaaaatactctaagtcaattgaactggttgagttgcatttaccttcactaccaaatttgcctccatattaccacacaacaaacggtttacctccacatcttatgaatactttaaaaactgcgttcgaaaggagttctcctaatttttccaaaatcctgcaaaccctcaaccccgacttggtaatatatgattttattcagccatgggcagctacattcgcatccagtatgaatatcccagccgttcaatttctgactttttctgctgctgtcttagcatttgccttccatatgttcgaaaaaagaggtgaagattttccttttcctgagatttacctgagaaagtatgagatggttcagatgaagaagattatggaagaaagcaaagacgataaatcgccgttcgatgaagcgctacgaaaatcaagagactttatcttggtgaagacctgcaaagaatttgaaggtaagtatatggattacttctcatctttagtatcgaagaaaatcgtacccgttggaagcctagtgcaagattccgtaaatgaggataataacgacgagataacacaatggctagataaaaaagaaaaatcgtctacggtttttgtttcgtttggcagtgagtatttcctgtcgaaggaagaaatacacgaggttgctcaaggcttggaactttccaaagtcaattttatttgggtaattagggtgccacaaggtgtaaagaatagcacaatacaggacgcattgcctaaggaatttctcgaaaaagtggaagatagaggtatggttctcgaaaagtgggcaccacaagcgactattttgaaacataaatctattggaggctttgtttctcactgtggatggtcaagtttcatggagagtgtcaaattcggtgttccgataattgcgatgcccatgcacatagatcagcctatgaacgctaaattagtcgaatatgttggtatcgggcttgaggccgtgagggacgacgataatggtaagttgcagagtaaggaaattgctaaagtcataagaaaagttgtagttgaggggtccggtgaagatgtccgtaagaaggttagggagctttctgaaaaaatgaacgcaaaaggagatgaagaaattgacggtgtagtggaagaattagtggccttatgcaacaacaagtaa

SEQ ID NO: 260 - DNA, 1323 bp, Artificial Sequence
  Synthetic Polynucleotide
atggaaaccaaaaagaatacgataagcgtattgatgcttccatggctggctcatgggcacatcagtccttttctcgagctagccaaaaagttagcgaaccgaaatttccatatttacttgtgttcgactccggtgaacttatcttctattaaaaagggtgttgcacaaaaatattcccagtcaatcgaattagtcgaattgcatttaccctcactccctaatctaccaccacactatcatacaactaacggcttgccccctcacctgatgaatacattaaaaactgcttacgagacagttgcaccgagtttttctaagcttcttcaaaccttgaacccagacttggtaatatatgattacaatcaaccttgggccgcagattccgctacttcagttaatattcccgcggtccagttccttaccttttccgctgccgttatcgcactaggaatacatatgtatgacaatcctggtgaaatgttcccatttcctgaaatttacttatccgagtatgaaaggctcagcttggataaggctctgcaaggtggaaaattcccatttgatgaaggcctgcgtcgcagtcaggacatcattttaatgaaaacgtgcagagattttgaggggaaatacatggattatctgtcaagtttagtgagcaaaaagattgttccagtcggtactttggtacaagaatctacaaacaaagatgatcatgaagaaataatgcaatggctagacaaaaaggacaaaagatcaaccgtatttgtgagcttcggctccgaatatttcctgtctaaagaggaaattcacgaggttgccgagggtttggaaagaggaaaggtcaactttatatgggttataaggtttccgcaaggtgaaagaatctctattcgagatgcgcttccagaagggtttttggaactcgttggtgaacgcggtatggtaatggaaggatgggctccacaggcaacgatccttcaacacgcttcgattggtggtttcatgtcgcattgtggctggtctagcttcacagagtcgatgaagttcggagtccctataattgcaatgcccatgcatattgaccagcctatgaatgcaagattggtggaatacatggatatgggcgtagaagcggttcgtgatgaaaatggtaagttacaaagggaggaaattgctaaagctattcgtaaagtcgtcgtggaagagtcgggcgaagttgtccggaaaaaggccaaggagctcagtgaaaaaatgaacgctaaaggtgacgaggagatagatggggtggttgaagagttagtggcactctgtaacaataagtaa

SEQ ID NO: 261 - DNA, 1332 bp, Artificial Sequence
  Synthetic Polynucleotide
atggaatcgaagaaaaacactctaagtgtacttatgttaccatggttggcgcacggtcatatttcaccgtttctggagttagcaaaaaagttgaccaataggaatttccatatctatatgtgctccacgcctataaacctgtcttctattaaaaaaaatatcactaagaaatacagccagtcaatagaattagtcgagattcacttgccctctctacctaacctcccaccccaatatcatacaactaatggattaccacctcaccttatgaatacattgaagatagcttttgaaatggctgccccgaaattcagtaagattctaagaaccctcaatccagacctagtgatttacgattataaccaaccatgggcagccgattccgcttcttcaatgaacatccctgcggttcaatttttgacatttggggctgccgttgtcagtatggcaatccagatatcgaaagacactgaagataaattcccttttccagaaatttacttacatgaatatgagatgataagcctcaaggaagctgtaaaggaatctccttcagataaatactcgttcgatgaggccctgcgtttatccagagacattatgttggttaaaacgtgtcgccatttcgaaggtaaatatattgattacctgtccaatctagtgtccaagaagatcgtgccggtaggctcgcttgtccaagagtctatagaccaagatgatcatgcggaaattatgcagtggttggataaaaaagaaaaaaactctaccgtttttgtgtcatttggttctgaatatttcttatcaaatgagcaaatacacgcagttgctcaaggactcgaactttcgaaggtaaactttatctgggttattcgatttcctctaggcgagagaattaatataagagatgcattgccagaaggtttccttgaacgtgtaggtgagcggggtacagttatagaagggtgggccccccaggcgactatcctacaacatccaagtattggcggttttgtgagccactgtggctggtctagctttatggaatcaatgaagtttggagtcccagttattgctatgcccatgcatatagaccaaccagtgaacgcaaggttagtagaatatattggaatgggcgttgaagctgctagagttgaggatggtaaattgcaaaatgaggagattgcaaaagttatcagagaagtagtcgttgaagatcgcggagaggctgtgagaaagaaagcaaaacaattgagcgaccgaatgaatgctaagggtgacaaggaaatcgacggtgtagttgaagaattagtcgcgctgtgcaataacaaataa

SEQ ID NO: 262 - DNA, 1365 bp, Artificial Sequence
  Synthetic Polynucleotide
atggctacgcaggttactgtatgcgggagtacactgagagtccttatgttcccttttttggcacatggacacataaccccgtttttaaacgtggccaagaaactcgcggacaggggtttcttgatctatttatgttctactcccgttaatctaaaaagcattattaataagatacctgaaaaatactcagagtccattcatcttgtcgaattacatttgccagaactgccagagctacctccacactatcacacaacgaatggcttgcccttacatcttaaccatatcttacacaaggctctcaaaatgtcgaaaccaaattttactaagattttgcaaaaccttaagcccgatttggttatttacgatatattgcaacagtggaccgaagacgtagcaaatgaacaaaatatccctgccgtgaaatttttaacattcggagctgccgttatttcttatttttcacatctaattcgaaaatctggtgttgagtttccgttccctgcaatatatctaagaaaaatcgaacaagtcaaaatgagtgaaatgatggccaagtcggctaaggataaacaaccagatgatgtagaccccttcgctgacggtaaggcacagactatgctcataaacacaactcgcaccatcgaggcgaaatacattgatatactgtccgaattaaatagttggaaagtgttcccagttggcccaccagtgcaagatccgatcacttctgacgtcgatgaagtcgaattaattgattggttaggtacaaaagacgagaatagcaccgtttttatctcgtttggttcagagtactttctgtccaaagaagatatggaagaaattgctttcggactcgaattgtcaaacgttaactttatttgggtagcacgttttcccaagggtgaagagaagaatttggaagacacactacctaaaggcttcttggaaagaattggggatagaggtagggttttggataaatttgctcctcaaagtcggattctgaatcatccatctacgggcggttttatcagccactgtggatggaatagcgtgatggaatccatagacttcggggttccgataattgcaatgcccatccatttggatcagccaatgaacgcgcgattagtagtagaactcggtgtagcggtggagattgttagagatgatgacggaaagattcatcgcggtgagatcgcaggaactcttaaggatgtcatcacaggtaagaccggcgaaaatctgagggctaaagccagagatatatccaagaacctaaagtcggtcaaaggggaggaaatggacgttgtgacggaagagttaatccgtttctgcaagaactctaccaaattgaactaa

SEQ ID NO: 263 - DNA, 1365 bp, Artificial Sequence
  Synthetic Polynucleotide
atggccacacaggtcaccgtttgcggctcaactctgagggtacttatgttcccctttttggcacacggtcatattacgccttttctaaacgtggctaagaaactcgcggacagaggattcttaatctacttgtgtagcactccggttaatcttaaatctataattaataagataccagagaaatattccgaatcgatccatttagttgaattacacctacctgagttaccagaattgccacctcattatcatacaactaacgggctcccattgcacttaaatcatattctgcataaggctcttaaaatgtcaaaacccaactttacgaagatattgcaaaatctcaagccggatttggtaatttacgatatcttgcaacagtggacagaagacgtggcaaatgaacaaaatattcctgctgtcaaatttctaaccttcggtgccgctgttatttcttattttagtcatttaatccgtaagtccggtgttgagtttcccttcccagcaatataccttcgcaaaatagaacaagttaaaatgtcggagatgatggccaagtctgctaaagataagcaacctgatgacgtcgatccattcgcagatggaaaagcacagaccatgctaattaatactacaagaacaatagaagcgaaatatatcgatattctatccgaattaaacagttggaaagtatttcccgtgggccctccagtacaagacccgataacttcagatgttgacgaagtcgaactcattgattggctgggcacgaaggatgagaatagtactgtatttattagcttcggatctgaatattttttatcaaaagaggacatggaagaaatcgcattcggtttggagcttagtaacgttaactttatttgggtggctcgattcccaaaaggtgaagaaaagaacttggaggatacattaccgaaagggtttttagagcggatcggtgatagaggtagggtactggacaaattcgctcctcaatctaggatcctaaatcacccatccaccggagggttcatctcccactgtggatggaatagcgtgatggaatcgattgattttggtgtacctattattgcgatgccaatccatttggatcaaccgatgaatgcgagattggttgttgaactgggtgtcgcagtggaaatagtaagagatgacgacggtaagatacacagaggcgaaatagccaggacattgaaggacgtcattacggaaaagatgggcgagaatctccgtgctaaagccagagatatttctaaaaatctaaaatttgttaagggagaggaaattgatgtcgtcactgaggaattaattaggttctgtaaaaactcaacgaaactaaactaa

SEQ ID NO: 264 - DNA, 1368 bp, Artificial Sequence
  Synthetic Polynucleotide
atggctacagaggttacgaagtatcctagtactctgaaagtcctaatgttcccatggttggcgtacggtcacataagcccctttcttaacttagccaaaaagttagcagataggggctttttgatctatttctgctcaactccgattaatattaagtctataattaaaaaaatccctgaaaaatactgtgactccatagaactcgtagaactgcatttgcaggaattaccagagctaccacctcattatcatacaaccaatgggttaccaccgcaccttaaccataccttgcaaaaagcaatgaagatgtttaagcccaatttcgtgaagattttgcaaaacttaaaaccagatcttgttatttacgacatcgtgcagcaatgggctgaacgtgccgccaatgagcaaaacatacctaccgtaaaactgatcccctcgggtgcggttgctgtcacatatttttttaatctggcaaacaagttaggagttgattacccattttctgctatttatctaagaaaaattgaacaagtaaaaatgtcagaaactttcgcaaaacacgccgaaggtaaagaagatgatgacgtcgacccattcgctaatgggaatatgcagatcgtgctcgttagcacgtctaggatattggaggcgaagtatatcgattactgtactgaacttatgaattggagagctgtccctgttggcccgcctgttcaagatccaatgtataatgatgacgcagacgaagtagagttaattgattggcttggaaagaaaggtgaaaacagtacagtatttgtatcgtttggtacagagtatttcctctccagagaagatcgcgaggaaatagcattcggcttggaattgtcaaatgtgaatttcatttgggttgtcagatatcctaacggagaagaacagaatctcgaggatgtccttccaaaaggttttttagaacgaattggtgataggggaagagttctaaacaagtttgctccgcaatcacgtatactcaatcatcctactacgggtggttttgtctctcactgtgggtggaatagtgttatggaatctatagattttggagttccaattatcgccatgcccgtgcatttggatcaacctatgaatgctaggttaatggtcgagttacaagtggctgtggaaatcgttcgcgacgacgatgacaagattcacagaggggaaatagccgagacattgaaaggcgtagtaaccggtaaaattggcgagaacttgagagcgaagattagagacatttccgagaacctgaagtcaactagaggagaagaaatggatgctgctgcaaacgaattgattcaattatgcaaaaacagcaataaatgtaaataa

SEQ ID NO: 265 - DNA, 1341 bp, Artificial Sequence
  Synthetic Polynucleotide
atggggactctaagagtacttatgttcccctttttagcttacggtcacatctcgccttatctcaacgttgcaaagaaactggcggacaggggatttttgatttatttctgctctacagccattaatttaaaatacacgataaagaaaattccggagaagtattcagatagcatccaattggtcgaattgcatcttccagaattaccagaactacctccccattaccacaccacaaatggcttaccacctcatttgaaccatacactgcaaaaagctttaaaaatgtccaaaccgaattttgccaagatacttcgttcattaaagccagatttggtgatatatgacgttttacagcaatgggctcagtctgtcgcaaacgatcaaaatattccagccgtgaaaatgctaaccagcggtgcagctgtaattagttacttctttaatctcagaaaaaaacctggcgttgagtttccttatcctgcgatctatttgactaagatagaacaagttaaggtggcagaattacttgctaaagcagataaagagaaggaaccagacgatgtagatccctttgctgatggtaacatgcagatcatgcttatgtccacttctcgagttctggaggccaaatacattgatttctttacggaattgggacattggaaggtcgtcccagtaggtccacctgttcaagacccgattatagatgaagttgacgacgttgaactaattgattggctaggtatgaaagatgaatcaagtactgtgttcgtaagttttggctccgagtacttcttatcaaaagaggacatggaagaaatagcatttgggttggaaaattctaacgtgaatttcatctgggtcgcgcgctttcccaagggagaagaacagaacttggaggatgtgttaccaaaaggtttcttggagagaataggcgatcgtgggagagttctcaataagttcgccccccaaccaaggattctgaaccacccgtccaccggtggatttatctctcactgtggttggaatagcattatggagtcaatggattttggagtacctataattgctattcctatgcatttagaccaaccgatgaacgcgcggctgatggttgagttgggagtggctatagaaatcgtcagagatgacgatggtaagtttcaccgaggggaaatcgcagaaactcttaaggatgtaatcacgaggaaaagaggggaaattttaagagccaaggttcgtgacatatctaaaaatctcaagtccgtgagagatgaagaagcagatgtcgttgctaaagaactgattcaactttgtaaagactcgaacaagtgtaattaa

SEQ ID NO: 266 - DNA, 1308 bp, Artificial Sequence
  Synthetic Polynucleotide
atgtttccctggctcgcacacggacatctttcccctttcttggaactgagcaagaaattagccaaccgtaattttcatgtgtacttctgttcaactccggtaaatttagattctatcaaaccaaagctatcgcctgagtatcactttagtattcaattcgttgaattgcatttaccatcttcaccagaactgccctcccattatcacacaaccaacgggttaccacctcatttgatgaaaacgcttaaaaaggcttttgacatggcgagtagctcttttttcaatatactaaaaactcttaaccctgatttattaatttacgattttttgcagccatgggctccagcactagcctcttcgttgaatatcccggctgtcaattttctgtgctcaagtatggcaatgtcgtgtttcggcctgaatctaaacaagaacaaagaaataaaatttttgttccccgagatttatccacgagactatatggagatgaagttattcagggtttttgaaagttcctcaaatcaaatcaaggatggtgaacgcgctggtagatgtattgaccaatcattccatgtcatacttgctaagacatttagggaactcgagggtaaatacattgattatgtaagcgttaaatgcaataaaaaaatagttcctgtcgggccgttggtggaagacacgatccatgaagatgatgaaaaaactatggaccaccaccatcatcatcacgatgaggttattaagtggctagagaagaaagaacggtcgaccacagtatttgtgtctttcggttctgaatactttttatccaaggaagaaatggaagagattgcgcacggattggagctttctaaggttaacttcatctgggtagtgagattccctaaaggcgaaaagattaatttagaagaatctcttccagaaggatacttagagcgtatacaggaaagaggtaagatagtcgagggctgggcccctcaaagaaaaattttgggtcattcaagtatcggtggatttgtcagccactgcggatggagttcaattatggaaagtatgaaattgggggttccgattatcgcaatgcccatgaacttagatcaacctattaacagtagaatcgttgaggccgccggtgttggcatagaggtatcacggaatcagtcaggtgaactcgaaagagaagaaatggctaagacaataaggaaagtagtcgtagagagagaaggcgtgtataaaggggaagaggaaatcgatggtgttgttgacgaattagtacaattatgtgacatgaaaacgaattacttgtaa

SEQ ID NO: 267 - DNA, 1341 bp, Artificial Sequence
  Synthetic Polynucleotide
atgaaagtattaatgctaccctggctggcgcatgggcacatatcaccattcttggagcttgctaagcgactcgccaaaaagaattttcatatttacttgtgtagtacgtccgtcaacttatcgtctatcaaaaataagattaccggtgaatatagcgacagtattgaacctgtggaattgcagttaccgtgcttaccagatctacctccacattatcacacaactaacggccttccccctcatctaatgacaactttgaaaaccgcatacgagttgagcgctccagatttttcgaatatcctgactgcattgcacccagatcttgttgtttatgacttcaatcaaccatgggccgctgaaatagcttcttcaaaaaacatccctgcggtgcaatttttgccggttggtgcaacaatgatggcattctccctacatatgttaaaatactctggaaaggagtttccccatccggaaatttacataagggattatgaaatgttaaagttccagtcaagaaatgaccaagtaaatgatgttagcgacagagaacgtatcctccaagctttggatcttagttgtaaaattcttttagtgaaatcttttaaagaaatagaggagaagtttatgaacacgttatctgtcgccagtggaaagaaggtagttcctgttggtccattggtacaagatgttaatatcgacgacatacaagatgaagaaatggaaattattcactggctagatcagaaagagaacgcctccgtcgtttttgtttcattcggcagcgaatattttttaactaaggaagagcgcaatgaaattgcgaggggtcttgagctgtcaaacgtgaacttcatatgggtaattagatttccactgggagggaaaatcaccatggaagaggctctccccgaaggttttctcgaaagagtcggcgatagaggtaaaattgtagatgggtgggcccctcaagcaaggatcttaaaacacgctaatacaggtgccttcctttctcattgtggatggtcttcaatgatggaatccatgaagtttggtgtcccaataattgcaatgcctatgtctgtagatcaacctgtcaatgctcgtttgatcgaagcagtcggtgtgggtctggaacctttaagagatgaaaaaggaaacctacagtcagcagaaattgcaaaagttattcggaaagtcttagttgatgaaagcggggaaaatgttagacgcaaggcgaaggagttgagtgagcaaatggaaatgaggggcgacgaggaagagatagacaatttagtcgaagaactactacaattgtgcagaaaaaacaacggaggttgctaa

SEQ ID NO: 268 - DNA, 1413 bp, Artificial Sequence
  Synthetic Polynucleotide
atggactataaggaggaagatcaccataatcgtttcagagtcctgatgtttccatggcttgcacatggtcatatcagtccctttttggaactcgcgattaaactaacacagaggaacttctacatatatttttgctccacgcctattaatttgtcttcaataaaacaacaattaacccaccaccatgagactactacaattttattcaacccgagccttatccaattaatcgatttacatctaccttcgttgccaaatctgccaccccattaccacaccacaaagtcattgcctccacatttgatgtctactttgaaaaaggctttagacctatccacaccaagctttagtaatttactttctacgattaaccccgatttgctgatttatgatttcatacagccttgggcccctacggccgcttcacgactaaatattccagcaatccaatttttgtcaaccggggctgcatttttctctttttttctacacctcctggaaaatccggcagtaaaatttccgttcccaagtatataccttactgattatgaagagagaagagttagccaaatcatgagttactctgacggactgaaggatcgcgataggttgattcaatcgataaacagatccagtaatattgtgcttattaaaactttccgtgaaatagaaggcaactatatcgactatttatcgagctctgttggtaaagaatttgttccggtaggccctttagttcatgagccacctgactttgataatcagatgaaaaagttttccgaatggctagtcaaaaaggaaaagtcatccgtggttttcgtatcatttggttctgaatatttcatgagcaaagaggaagttgaagaaatcgcttacggattagaattgagtaaagtgaacttcatttgggtcataaggtttcctgaggaagaggataatatgcgtaagatctctttgcacgaagtattgccagaaggtttcatggaaagagtcggagttaaaggtatggtggttgagggttgggcgccacaagcaaaaattctggtaaattgtaaaatcggagggtttgtcagccattgtggctggtcatccgtcatggagtccatgaagtttggcgtacccgtaattgctatgcccatgcacttagatcagcccctcaacgcgagacttgttgtcgaactgggtttaggagttgaggtgcaacggggtggtgacgggggctgccgattcgagcgtgaagaagtggctaaggtaataaaagaagttgtaatggaaaaggagggtgaggaagttagacggcgcgccagagaaatatcagaaaaaatgcgcgaaaagggtgaagaagaaattgatgttttggtggagaaattagagcagttgtgtaaaaagaagaaagaacattatctggtctaa

SEQ ID NO: 269 - DNA, 1356 bp, Artificial Sequence
  Synthetic Polynucleotide
atggacgggaggcactccagaatatcggtactgatgttcccctggctagctcatggacatatttcaccttttttggaactcgcaaagaaacttaccaaacgcaactttcacatctacttctgtagtacaccggttaatttacgtccaattaaggagaaattgcctgaaaagtatagcctttctattcaattagtcgaattacatttgccatccttaccagaactaccgcctcattatcacactacgaatggcttgcccccacatctgatgccaactcttaaaaaagcctttgatatggcgtcacccaacttctcgacaatagtgaagaatttgcgacctgatctacttatctacgactttttacagcaatgggctcctagtatagctctgtctcggaatatcccagcagttgagtttctgccaacgaacgcagccatgacttcttttgtgattcacctcacaaaaaatcctggtgtagagttccctttcccagaaatctatttgagagataactacgctatatcaaagtttcaaaacgttttagaaagctctgcgaatggtattaaagataccgaaagagctgtcgaatgctgtgagcagagttccgagattgttttgattaaaacatttagagaaatcgaagccaaatatttggactatttatcagagttaaccggaaagaagatcgtacctgttggtccgctcgtccaagatccagtccatgaatacgatgaaaagccgggcataatggaatggttaaataataaagaaaggtctagcactgtgtttgtaagcttcggatctgaatatttcctatccaaagaggagatggaagaaattgcatacggtcttgaacaaagtatggttccattcatttgggtggttagatttccaggtggcgctaaagtctcactagagatggctttgcccaagggatttttggatagggtaggggacggtggtatggttgtggagggatgggccccgcagactaagattttggaacacagctccatcgggggtttcagttcgcattgtggctggtcatctgttctggaatctatgaagctcggtgtaccaataattgcaatgccgatgcatttagaccaacctatcaatgccagactcgttgaggaagtagggatgggacttgaggtcgagagggatatgaacggtaaactcaaacgcgaagaagttgctaaagtgataagagaagttgtagttgaaaaagctggggaatcagtgcgtcagaaggcaaaggaactcaaagagaaattgatttctaaaggtgaagaagagatcgatgaagtcgtccaagaagtggtccaattgtgcagaaagaaaaaccgacattaa

SEQ ID NO: 270 - DNA, 1341 bp, Artificial Sequence
  Synthetic Polynucleotide
atggaggaagaagcctccaaactgcacatagtgatgttaccttggttggctatggggcatcttctcccattctttgaactaagtaagcgcttggcgttaaaaggcgttgagatttcatttttcagcactccgtctaacatccatcgactaccatcgattccccagtctattacacccaatataaattttatctcatgcagcattaacaatatcacgtccaacattgaaaataccgtagatttaagaagtgaagcagctcgtcctttgttgatacaagcatacgccacatttgagagtcacttaactgctttcctttctgacgcgtcaaggccaaagcctgattggattatctatgactttgcagctgcctcttgggcaccagctctggcatcgagattcaaagtcaacagcgcctttttctgtttgtttaatgctgctgcggttgccttctttatccatgcaaaggattatgattcaccggaaaaacttagtactgtccccgactcgattcctttcccaaccactgttgcttttcggccatttgaggctaggcatgtgtactccatgttaagtcaaaagagcaatcaaacagaaccgaaaacacagtctatacaattcacgctcataagaacctgtaaagaatttgaatcgaagtgggttgatttgctaggagatatctatgcacctgtaggtttactgccaccttcttttgacaaagaagaggaatcagaaacgtggactcgcatttgtgagtggttagatgagcagaaagaatcatctgtcatttatgtagctttcggaagtgaagccattctcacaacggagcaaatagatgaaatcgctcttggtttggagaagtctggtctaccatttttttgggtgctaagagttggctctcccccgcaaggtttcgaagaacggaccgccgggagaggtcttgtctggatgggctgggcgccacaagcgagattgttagcacaccgtacagttggaggttttttgacccatgggggatggaactccgtggtagagggtctggttgtaggagcacccatggttgtcctaccaatggtcttcgaacagggtctgaatgccaggcatttggtggaatcaggctacgccgttgaggtagcgagaaatgacgaagatggttcattttctggtgaagagattgctagaaagttacgaatggtgatggttgaagaagagggagaagaactgaggaaaaaggcaagaatgggtaaagaggtgttcggcagcgaaaagttgcaagaagaatatttagacgagcttgccaaaaaattatgggaaaaacgtaaggttgtagctgaacctgtgtaa

SEQ ID NO: 271 - DNA, 1335 bp, Artificial Sequence
  Synthetic Polynucleotide
atggtagctaagaaaaacaccataagtatcttaatgctaccgtggctggcgcacggccatattagcccttttcttgagttggcaaaaaggttgacaaagaaaaatttccatatttacatgtgttccacgccagttaatttaaactctataaagaaaactgtcactgaaaaatattcgcagtcaatcgaactcgtggagcttcatttaccatctttgcctaatttacccccatattaccacacaactaacggattaccacctcatctaatgaataccttgaagattgcttttgaaatgtcaagtccaaatttctctaagatcctacaaaccctaaatcccgatttggttatttatgactttattcaaccatgggccgcaacgttcgcctcctcgatgaacatacctgctgtccaatttctcacattttctgcgggtgtactggcattcgcttttcatatgttcgaaaaacctggggaggattttccgttccctgaaatctatctcagagaatacgaaatgttacagatgaaaaaaattatggaagagtcaaaggacggtaattcacaatttgatgaggccttacgtaaatcgctggattttattttggtgaaaacgtgcaaggaatttgagggtaagtacatgaattattttagctctcttgttagtaaaaaaatagttccagtcggctccttaatacaggatactgtgagcggtgacgataacgaagaaattacacaatggctggataagaaagaaaaaaactcaggagttttcgtttcttttggatcagaatattttttgtcaaaggaagaaatacacgaggtagcacgcggtttggaactttcgaaggtcaacttcatttgggtgataagattcccgcaaggggaaaaaaattctagtatcaaagacgctctacccaaagggtttttggagagagtagaggatcgtggtatggttttggagggctgggcaccccaagctgccatactgaaacataagagcatcggtggtttcgtttctcactgtggctggtccagttttatggaatctgtgaagttcggtgtaccaattattgcaatgccgatgcacttagaccagcctatgaacgcgagactggtcgaatatattggatttggagttgaagcagtaagggatgacaatggaaaattacaatcggaagagattgctaaagttattcgaaaggtcgtgatggaggaatcaggcgaagatgttcgcaagaaagtaagagagctctgcgaaaaaatgaatactgaaggtaatgaggaaattgacggggttgtagaagagttggtcgccttgtgtaataacaagtaa

SEQ ID NO: 272 - DNA, 1377 bp, Artificial Sequence
  Synthetic Polynucleotide
atggatgcttctatggaaattatcaaccaaaaacctgtcaggatattgatgtttccctggttagggcatggccacattagcccgttcctggagctcgcaaagaaacttattacacgaaattttaccatattcctatgctcaactcctggtaattttatctccattaagcagaaactaatcaacgaaaatttgacggaaaagatacatttagttgaattacgtcttccaagtttgtcggacctgccaagacattaccacactacaaacggtcttcctccccatttaatgtccacgttgaaaaaggccttcgcgaaatcaagaccaattttttctcaaatcttaaataccgtagaacctgatttattgttgtatgatttacttcaaccatgggctccaaagctagcactcgagaaaaatatacctgccgttgtgtttgtcacaagtagcgcaactatgttttcttatatgttccacacttttcgctacccaaatatggaatttccgttctcgtcaagtatatattaccgagactatgaactaaccaggatgctcaaaaaccaggatctggaaccaattgagcagcaacaaaaagacaagacatctgtaaaactgtgttttaagaggtcgtttgatattgtgttgataaagggattcaaagaaatcgacggtaaatactgtgattatatatcttcattaaccaaaaagaaaattattccggttggacctttagttcaagagactacgtctgaagatggcaattcacaaatccttacatggttgaaccagaaggagaagggtagcacggttttcgtatcctttggatctgaatatttcttgtcccaggaagatagagaggagattgctcatggtcttgaacaatcgagagtaaattttatctgggttctccggttccccaaaggagaaaaactcaagctggaacaagcgttgccacaaggtttctttaagaaagtgggtgaacgtgggatggtcgtggaagactgggctcctcaggtgaagatactaggcaaccccaatattgggggatttgtttcacattgtggttggaacagtgttatggagtccatgaaattaggtgtcccgattatcgcaatgccaatgcacttggatcaaccattaaatgccagattggttgaggaggtaggagtaggcctggaagtagtcagagacaaacacggcaaattggattcagaaaaaatagctcaagtgattaattttgtcgttttggaacaacgtggtgaatctattagagcgaaggcaagaaaaatgtcggagactatccgtgttaagggagatgaggaaatagatgaagttgtccaagagctactaaaattatgcaaaaggagtaacgtggtataa

SEQ ID NO: 273 - DNA, 1356 bp, Artificial Sequence
  Synthetic Polynucleotide
atggtatgctctgaacgacgtacactaactattcttatgttaccatggttggcccacgggcatatatcgccttttttagagctggcaaagaaattgacgagcaaaagaaacttccatatctttatttgtagtacccccgtgaatctcacatctataaagccgaaattatccccaaagtattcacactgtattgaatttgtcgaactacatttacctcatgacgatttgccagaactacctcctcactaccatactaccaatggccttccaccacatttgatgagtactctcaaaagagctttcgatatgtcgtcaaacaatttctccacaatcctgactgctgttaaaccagaccttcttatttatgattttctgcaaccctgggcgcccaccttggcaagcttgcagaacataccatctgttgagtttattacaacgtcagccgcactaacgagcttcagtgtccaccatttaaggaatccgtctgataagtttcctttccctttaatttacttgcaagactatgaggctaagaagtttaataacatccttgaatcctcgtcaaatggaataaaagatggtgatagaattttacaatgctctgaactctcctcgggtatcatattagttaaaacttctcgcgaaatcgaagcgaaatacgtagactatttgagtggtttgatgggaaaaaagatcgtgcccgtgggccctctcgttcaggaaccaatggatctgaaagtcgatgaggaaacatggataaccaagtggctaaataaaaggaagagatcaagcgtagtttatgtctgtttcggttctgaatactttctaagtagggagcaaattgaagagctggcacatggtttagaattgtcaaaagtttcctttatatgggtaattagattcccgaaggaagagaaagggaaccgtgtggaagaagttttaccagagggatttttagaaagagtgggtgaaaaaggtgtcatcgtggaagggtgggctccacaagctaaaattttgaaacatagtagtgttggaggcttcgtttcgcactgtggttggagttcagtactcgagtctattaaattcggcgtccccatcatcgccatgcctatgcacctagaccaaccaattaatagcaggcttgtcgaggaagttggagtaggtgtagaagtaaagagaaccgcagaaggaagtttagaacgcaaagaggtagctaaggtaattagggatgttatggctaaaaagattggagagggtgttagaaagaaagctttagaaatccgtgataatatgaagaaaaaagaagatgaagagataaacggcgtcgttgaagagttgatgcagttatgtacttaa

SEQ ID NO: 274 - DNA, 1353 bp, Artificial Sequence
  Synthetic Polynucleotide
atggacactcgcgagcgtggaaccataaaagtacttatgttgccctggttaggtcatgggcacgtcagtccgttcctagaactggccaagaaactcacatcaaggaagtttgtgatctacttgtgttccacgccaattaacttatcgagcattaaaaagcgagttactgaaaatgattctttatctttggagcttgttgaattacatctgccaacattgcctgaactacctccacaccatcagactaccaatggtctgccactacatctccaccctacattaaaacaagcattcgatatgtctagttcatccttttcaaacatacttcaaactttgcggccggatctagtgatctatgacattctgtatccaagggctgcgcccacagtagcttcgagctacaatattcctgtcgttcaattaataccaaccgcagccgcattgatcagttatggccttcatgtttttcagaaacatggtgtggagttcccgtttgctgctattcaacctagaggacctagacgtgccccacctagagaagctcccgttgacgatgatactaaagaaagatttttgggcggtataagacaatcctgcaagatgattcttctgaacacgttcagggagttagaaggtaaatacattgactatctctctacattgacggataagaagattgtccccgtaggtcccctcgtacaggatacgaatatcgttgaacaaaatgacagccagatcatgcaatggttaggaaccaaagatgaatttagtactgtttttgtatcttttgggtccgaatacttcctttcaaaagaggaaatggaggaagtcgctcacggcttggaattatccaagttgaacttcatatgggttgtgagatttccgttcgtggaaaaaatagaattgcaggaagcactcccaaagggattcttagaccgcttggggaacagaggtctggtagtggaggattgggcgccacaagcgcaaattttagcacattcatctacttcaggttttgtttcacactgtggatggaatagtattttagaaagccttaagttcggcgttccgatcattgccatccctatgaaatatgatcagcccatgaatggtcggctagttgaagacgtcggggtagcagttgaggtcaagagagatgaaaacggaaaattgaatagggaggagatagctcaagtgattagaaaggtcgtcggtgaaaaggatggggaagatgttaggataaaagcaagggaatttagtgaaggtatgcgtatgaaaggcgaggaggagatcgatggattggtagaagaactggttcaactttgcaatgaggctaaattgctgaagaactaa

SEQ ID NO: 275 - DNA, 1350 bp, Artificial Sequence
  Synthetic Polynucleotide
atgaactcgagaaggcaaagccgtattaaagttctggtgcttccgtggttagcgcatgggcacataagtccttttttggagctctccaagcagttaatgaaacaaaagttctacatctatttttgctcatctcccgtaaatctatctcggattaaaggaaaactgacgggcaattattcacattccatccaattggtcgaattacacttgccatctctaccagaattgcctccacattaccacaccactaacggtcttccccctcatttaatgcctacactcaagatggcactggacatggcttccccaagtttcactaatattcttaaaacattgtctccagatttattgatttatgattttatccagccttgggccccggctgccgcagctagtctaggtataccttcagttcaattcttatcgaacggtgcagcagctaccgcgtttatgattcatttcgtcaagaaaccagggaatgagtttccattccccgaaatatacttaagagactatgaaacttctggctttaaccgatttgttgagagcagtgcaaatgcacgcaaggataaagaaaaagccagacaatgtttggaacaatcatcaaatgtgatactcattaggagtttcaaagaaattgaagagagatttattgatttcctgtcaaatttaaatgccaagacagttgtaccagtaggtcccctactacaggaccagctagatgaagaagatgccgagactgagatggtggaatggctctctaaaaaggatccagctagcagtgtttttgtttctttcggaagcgaatattttctttccaaggaggaacttgaagaagtcgcatacggtttggagttgtccaaagtaaacttcatatgggtggtcagatttccaatgggagacaagacgcgtgtggaggaagctttaccggaaggcttcttaagccgcgttggtgacaaagggatggtagttgagggttgggctccgcaaaaaaaaatcttaaggcattcgtcaataggtggctttgtgtcgcactgtgggtggggaagtgttatggaatctatgaacttcggtgtccctattgtggcgatgccgatgcatttggatcaaccatttaatgctaagctggtagaagctcatggagttggaatcgaagtaaaaagagatgaaaatggtaaactccaacgggaagagattgcaaaggttatcaaggaagtggttgtcaaaaaatgcggcgagatagtccgacaaaaagctagagaattttccgaaaacatgtcaaagaaaggagatgaagaaatagttggtgtcgttgaaaagctagttcaattatgtggtaagagaaattaa

SEQ ID NO: 276 - DNA, 1365 bp, Artificial Sequence
  Synthetic Polynucleotide
atggccacggaacagcaacaagcatcgattagttgcaagatactgatgtttccgtggttggcgttcggtcacatttcatcttttctacaactcgctaaaaaattaagcgacaggggattctacttttatatctgtagcacccccattaatttagattccatcaagaacaaaataaatcagaactattcgtcttcaattcaattggtggatcttcatctgccaaattccccacagttacctcctagcttgcatacaacaaacgggctacctccccaccttatgtcaactttaaaaaatgctttgattgacgctaatccagatctatgtaagataatcgcgtctattaaaccagatttaattatctacgacttgcatcaaccttggaccgaggcattggccagtcgacataatattccagcagtatctttctcaactatgaacgctgtctcatttgcttatgttatgcacatgtttatgaatcctggcatcgaatttcccttcaaagccatacatctaagtgattttgaacaagcaagattcttagagcaattggaatctgctaagaatgatgcatctgcgaaagatccggaattacaaggttccaagggattctttaacagtacttttattgttcgtagttccagggagatagaaggtaaatacgtagattatctcagtgaaattttaaagtctaaggttatcccagtctgcccggtgatctctttaaacaataatgaccagggccaaggtaataaagacgaagatgaaataattcagtggctagataaaaaatcacacagaagctccgtttttgtttctttcggtagcgagtactttcttaacatgcaagagatagaagaaattgcaattggccttgaactgtcgaatgtaaacttcatctgggtcttgagatttcctaaaggtgaggacacaaaaatagaagaagttcttccagaaggattcctggatcgtgtcaagactaaggggcgcattgtacatggttgggccccgcaagctagaatactgggccatccctcaataggaggatttgtgtcgcattgtggttggaactctgttatggagagtatacagattggagtgccaatcatcgccatgccaatgaacctcgatcagccatttaatgcaagattggttgtagagataggtgtcgggattgaagtggggcgagatgagaatggtaagttaaaacgcgaaagaattggcgaagttatcaaggaagttgctattggtaaaaaaggtgagaagctaaggaaaacagcaaaagacttgggccaaaagcttagggatagagagaaacaagacttcgacgaactcgcggccacgctgaagcagttgtgtgtataa

SEQ ID NO: 277 - DNA, 1356 bp, Artificial Sequence
  Synthetic Polynucleotide
atggtctatagcgagaggagaacgctcacaatcctgatgctaccgtggttagcgcatggtcacatatccccttttcttgaattggctaagaaattaacttcaaaacgcaacttccatatttttatttgttcgacccccgtgaatttgacaagtataaagccaaaactttctccaaagtactctcactgcatcgaatttgttgaattacatttgcctcatgacgatctaccagagttgccgcctcaatatcacactaccaatggactacccccacatttaatgtcaacattaaaacgtgcattcgatatgagttccaacaatttttctactattttgactgccctgaaaccagacctgttaatttacgatttcttacagccttgggctcccagcctggcatcgttgcaaaatataccaagtgtagaatttattacaacttcagctgccctgacgtctttctcagttcaccatctaagaaaccctatcgataaatttccgttcccatccatttatctccgagactatgaagcaaagaaattcaataaccttttggaatcatccagcaatgggataaaggatggtgatagagtcctccaatgttctgacctatccagtggcatcatccttgtgaagacctctagggagattgaagcgaaatacgttgattatttgagtggtttaatgggaaagaaaatagtaccagttggcccattagtccaggaacctatggatctgaaggtggacgaggagacttggataatgaaatggctcaataaaagggaaagatcatctgtagtttacgtttgttttggatcggaatactttttgtcaagagaacaaattgaagagttagcccatggtttggaattgtctaaagtgagctttatttgggttatccgttttcccaaagaggaaaagggtaacagagtagaagaagtcctacctgaagcattcctagagcgcgttggggagaaaggggtaattgtggagggctgggctccacaggcaaagatcctaaatcactcgtcagttggtggttttgtttctcattgcggttggtcatctgtgttggaaagcattaaattcggagtgccaataatcgctatgccgatgcacttagatcaacccattaattccaggttagttgaagaagtcggcgtcggtgtcgaagtaaagagaacagctgagggatcattggagcgaaaagaagtggccaaagcaattagagatgtcgttgctaagaaaataggtgaaggtgtacggaagaaagcgctagagatccgtgataatatgaaaaacaaggaagacgaagaaatcaacggggtagttgaggaattaatgcaattatgtacctaa

SEQ ID NO: 278 - DNA, 1344 bp, Artificial Sequence
  Synthetic Polynucleotide
atggagagcgatgtgctgcgtatagtagttttgccctggctcgcgatgggccatttacgaccatttctacgcttagccaagagtttcgcaagaaaagggcacagagtttcccttatttctacaacgggtaatatcaggagattgccgaaagtccctgaagaactgtcagaattggtagacctagttggatttcctttaccagagattcgggatttaccacctggttgtgaatcgtctatggacactcccccacagaagcaataccttttgaggaccgctttagattcactccatgatcccacaagaaaatatcttgaagaggaaaagcctgattggatcgtgtatgactactcgttcagttgggtcccaaaaatggctgccgaattgggtatttctggagcatatttttgcgtttatccggcttgtttcttgacttttgtaggccaaggcaaaggtcatgctgagtacaaattggaagacttagtcaacgtgccaaagtggataccatttccctccaatatggcattcagacctcacgagctaatgcgaaacaaggaaatgcaacatgcaaccgaatctgatgttgaacgtttcaatctcgttaaggaatcatcttccatctttctattgaggtccagccctgagattgaaagtgaatggatagaattactggccaaacagtacgataaacctgtctttccaacaggtttcttatcagtggccgacgaagagaatgaaactccagcggatgatagatggattcaaataactgattggctagacgctcaacctccatccagtgttgtttatgtatcgtttggatcagaggtagttttaacaagaaaagaagttcacgagatctctattggtttagaacgtagcggatcgccctttttatgggccctcttagatagatctgatcagttggaactactgccagagggttttctgcaaaacgtcggggaccgggggagggtatattccggatgggctcctcaggtggcaatacttagccatcccagtgtcggcggtttcttgactcattgcggttggaatagtgtgacggaagcacttggttgtgggcgcgtgttgatcctttttccggttatgaacgatcaaggattgatagctagactaatggactcaaaagggctgggtattgagattcctagggatcacatggatggtagtttttcaggtgatgacgtagccgaaaccgtaagatttgctatggtcgaagaaggtggcgggaagctaagggaaaatgcacgcaagatgaaagaacttttggaggacaaggaaaagtctcaacactacgttgacaaagctctggaatacatgtaa

SEQ ID NO: 279 - DNA, 1350 bp, Artificial Sequence
  Synthetic Polynucleotide
atggaagcgaaaaagaatactattagtatacttatgttgccgtggctggcacatggccacatctcaccattcctagagctcgctaaaaagttaacgaaccgcaattttcatatttacttgtgttctacccctattaacttatcgtccataaaaaagaatgttacaaagaaatattgcgaaagcatcgagttggtggaattacaccttccctctctaccaaatttacctccacattatcatactaccaacggtctgccccctcacttgatgaacacactgaaaaaagcttttgaaaatgcctcaccaaatttcagtaagatcctacagactctgaatccagatttggtcatttacgactttaaccaaccctgggcagccgaatttgcttcttccatgaatattccggcaatacaattcttaacatttagtgctgccatagtagccttacttgcgcttcatattatgttcgataagtcaggagagaaatttcctttcccagaaatatatctgagagaacatgaaatgctccagatcaaaaagtcattggaggaatcgaaagacgagaactacaaggatcccttcaatgatgcattgaggttatctcgggatattgttttggtaaaaactagccgagactttgaagggaaatatatcgactacttaagtaaattggtgagcaaaaaaattgtccctgttggttccctggttcaagattctatagatcaagatcacgatcacgaagaaattattatgcagtggttagacaagaaggagaaatgttcgtctgtctttgtgtccttcggctcagagtattttctttctaaagaagaaatgcatgaagtagcacaaggtcttgagttttctaaggttaactttatctgggttatacgtttcccacaaggagaaaagaactctattcaggacgtattaccacaaggatttctcgaaagagtcggcgaaagaggtatggttttagagaagtgggctcctcaggcagctattctacaacataggtcaacaggaggttttgtgagccactgcggttggagttcagtaatggagtcgatgaagtttggagtacccataattgcgatgccaatgcatatcgatcaaccgatgaatgctagaattgttgaatatattgggatgggtgtggaggccctaagagatgaaaatggtaaattgcaaagcgaagaaatagccaaggttatgcgtgaagtcgtcatcgaagaaagtggtgaaggcgtgagaaaaaaaaccaaagagctctcagagaagatgaatatgaagggtgatgaggaaattgacggcgttgtagaggaattggttgctctatgtaacaacaaataa

SEQ ID NO: 280 - protein, 442 aa, Panax ginseng
MDNQNGRISIALLPFLAHGHISPFFELAKQLAKRNCNVFLCSTPINLSSIKDKDSSASIKLVELHLPSSPDLPPHYHTTNGLPSHLMLPLRNAFETAGPTFSEILKTLNPDLLIYDFNPSWAPEIASSHNIPAVYFLTTAAASSSIGLHAFKNPGEKYPFPDFYDNSNITPEPPSADNMKLLHDFIACFERSCDIILIKSFRELEGKYIDLLSTLSDKTLVPVGPLVQDPMGHNEDPKTEQIINWLDKRAESTVVFVCFGSEYFLSNEELEEVAIGLEISTVNFIWAVRLIEGEKKGILPEGFVQRVGDRGLVVEGWAPQARILGHSSTGGFVSHCGWSSIAESMKFGVPVIAMARHLDQPLNGKLAAEVGVGMEVVRDENGKYKREGIAEVIRKVVVEKSGEVIRRKARELSEKMKEKGEQEIDRALEELVQICKKKKDEQ

SEQ ID NO: 281 - protein, 452 aa, Cucumis sativus
MAMDTHQASTPTTTTILMFPWLGYGHLSPYLELAKALSTRKNFLIYFCSTPVNLDSIKPKLIPSPSIQLVELHLPSSPDLPPHLHTTNALPPHLTPVLYQAFAAAAPLFETILKTLSPHLLIYDCFQPWAPRLASSLNIPAIHFNTSSAAIISFSFHATHRPGSKFPFSDFVLHNHWKSKVDSNPSEQIRIVTESFFECLNKSRDVILINSFKEVEGEHMDYIFLLSKKKVIPVGPLVYEPSENDEEDEDYSRIKNWLDKKEALSTVLASMGSESYASEEEKEEIVQGLVESEANFIWVERINKKGDEEQQIRRRELLEKSGERAMVVEGWAPQGKIQKHGSIGGFVSHCGWNSVLESIVSGVPIIGVPVFGDQPINAGVVEEAGIGVEAKRDPDGKIQRKEIARLIKEVVIEKSREELRMKVREMSEVVKRKGDEKIEELLTQISRFFNIS

SEQ ID NO: 282 - protein, 452 aa, Cucumis sativus
MDVQKSRDTPTTILMLPWIGYGHLSAYLELAKVLSRRNNFLIYFCSTPVNLDSIKPRLIPSSSIQFVELHLPSSPEFPPHLHTTNALPPRLTPTLHKAFAAAASPFEAILQTLCPHLLIYDSLQQWAPQIASSLNIPAINFNTTAASIISHALHNINYPDTKFPLSDWVLHNYWKGKYTTANEATLERIRRVRESFLYCLSASRDITLISSCREIEGEYMDYLSVLLKKKVIAVGPLVYEPREDDEDEDYSRIKNWLDKKEALSTVLVSFGSEFFPSKEEMEEIGCGLEESGANFIWVIRSPKGEENKRVEEALPEGFVEKAGERAMIVKEWAPQGKILKHRSIGGFVSHCGWNSVMESIMLGVPVIAVPMHVDQPYNAGLVEEAGLGVEAKRDPDGMIQREEVAKLIREVVVDKSREDLRTKVIEMGEILRSKGDEKIDEMVAQISLLLKI

SEQ ID NO: 283 - protein, 443 aa, Eucalyptus grandis
MDNMQRPIKVLMLPWLAHGHVSPYLELAKRLSTRNFHIYLCSTPVNLSSIKPKISEKYSSSIELVELHLPSLPDLPPHYHTTKGLPPHLMNTLKAAFDMASPGFGDIVTSLGPDLLIHEFLQPWAAEVAKSHGLPSVVLFNVGAGTISFMFHMIKNTGNKFPFEAIRLHDYELAKIRKAADDSTARVNEKDRVLQSVERSSNFILLKTFREMDGKYMDYLSSLLGKKVLTVGPLVEDPSNTEDGDSIIEWLDKREKSSTIFVSFGTEYFLTEKEREEIAHGLELSNVNFIWVIRFSVEESVELKEALPKGFLERVRDRGLVIDGWAPQGKILEHPSIGGFVSHCGWGSIMESMKSGVPIIAMPMQHDQPLNARMVEEVGVAMEVKRNKSGELERLEIAKVIKHVVAEKDGDSVRKKTKEMSDSIRNKGEEELDEVAEALVQLC

SEQ ID NO: 284 - protein, 442 aa, Panax quinquefolius
MDNQKGRISIALLPFLAHGHISPFFELAKQLAKRNCNVFLCSTPINLSSIKDKDSSASIKLVELHLPSSPDLPPHYHTTNGLPSHLMLPLRNAFETAGPTFSEILKTLNPDLLIYDFNPSWAPEIASSHNIPAVYFLTTAAASSSIGLHAFKNPGEKYPFPDFYDNSNIIPEPPSADNMKLLHDFIACFERSCDIILIKSFRELEGKYIDLLSTLSDKTLVPVGPLVQDPMGHNEDPKTEQIINWLDKRAESTVVFVCFGSEYFLSNEELEEVAIGLEISTVNFIWAVRLIEGEKKGILPEGFVQRVGDRGLVVEGWAPQARILGHSSTGGFVSHCGWSSIAESMKFGVPVIAMARHLDQPLNGKLAAEVGVGMEVVRDENGKYKREGIAEVIRKVVVEKSGEVIRRKARELSEKMKEKGEQEIDRAVEELVQICKKKKDEQ

SEQ ID NO: 285 - protein, 442 aa, Panax ginseng
MDNQKGRISIALLPFLAHGHISPFFELAKQLAKRNCNVFLCSTPINLSSIKDKDSSASIKLVELHLPSSPDLPPHYHTTNGLPSHLMLPLRNAFETAGPTFSEILKTLNPDLLIYDFNPSWAPEIASSHNIPAVYFLTTAAASSSIGLHAFKNPGEKYPFPDFYDNSNITPEPPSADNMKLLHDFIACFERSCDIILIKSFRELEGKYIDLLSTLSDKTLVPVGPLVQDPMGHNEDPKTEQIINWLDKRAESTVVFVCFGSEYFLSNEELEEVAIGLEISTVNFIWAVRLIEGEKKGILPEGFVQRVGDRGLVVEGWAPQARILGHSSTGGFVSHCGWSSIAESMKFGVPVIAMARHLDQPLNGKLAAEVGVGMEVVRDENGKYKREGIAEVIRKVVVEKSGEVIRRKARELSEKMKEKGEQEIDRALEELVQICKKKKDEQ

SEQ ID NO: 286 - protein, 448 aa, Panax ginseng
MDIEKGRISIVMLPFLAHGHISPFFELAKHLSKRNCNIFLCSTPINLSSIKNRVSDKDSSASIKLVELHLPSSPDLPPHYHTTNGLPSHLMVPLRNAFETAAPTFSEILKTLNPDLLIYDFNPSWAPEIASSHNIPAVYFLTSAAATSSMGLHAFKNSGEKYPFPDFYDNSNITPEPPSADKMKLFHDFVACFKRSCDIILIKSFRELEGKYIDFLSTLSKKTLVPVGPLVQDPMGHDEDPKTGHLINWLDKRAESTVVFVCFGSEYFPSNEELEELAIGLEISMVSFILAVRFPEGEKKGILPEGFVQRVGDRGLVVEGWAPQARILGHSSTGGFVSHCGWSSIMESVKFGVPVIAMARHLDQPLNAKLAAEVGVGMEVMRDENGKYKREAIAEVIRKVVMEKNGEVMRRKARELSEKMKVKGEQEIGRAVEELVQICKKKKQHAQY

SEQ ID NO: 287 - protein, 459 aa, Daucus carota
MTEVFMNAKSKKLSVLMFPWLAHGHLSPFLELGRKLSKRNFSVHLCSTPANLSSIRKRMGEESSIQLVQLDLPSLPNLPPCWHTTNGLPPHLMDTLKSAFDMAKPGFSKILETVKPDLLIYDFLRPWPAQAAVDLRIPAVQFIATSATMTSFMLHTFKYPSIDYPFSTIFYREYEKAQVSRSGECDELHKAIESLEMSDTVILIKGIKEMEGNFSDYLSTMSGKKIVHVGALVQDPIRKDDSDIIQWLNKKKKYSTIFISFGSEYFLSEEDFKELAHGLMLSNVNFIWVVRFPVGEIIRVEDKLPAGFHKKVGARGLIVEGWAPQANILGHSSIGGFVSHCGWNSVNESMYFGVPIIAMPMHLDQPINARLVKDFGTGIEVLRDENGRVKREKIASVIKQVVATRNGRIMRKKAKELGASIRQKGDEEIDEVVKELMQLSLFKKAEIEIDEVVRELSRP

SEQ ID NO: 288 - protein, 462 aa, Corchorus capsularis
MDSKQKKMSVLMFPWLAYGHISPFLELAKKLSKRNFHTFFFSTPINLNSIKSKLSPKYAQSIQFVELHLPSLPDLPPHYHTTNGLPPHLMNTLKKAFDMSSLQFSKILKTLNPDLLVYDFIQPWAPLLALSNKIPAVHFLCTSAAMSSFSVHAFKKPCEDFPFPNIYVHGNFMNAKFNNMENCSSDDSISDQDRVLQCFERSTKIILVKTFEELEGKFMDYLSVLLNKKIVPTGPLTQDPNEDEGDDDERTKLLLEWLNKKSKSSTVFVSFGSEYFLSKEEREEIAYGLELSKVNFIWVIRFPLGENKTNLEEALPQGFLQRVSERGLVVENWAPQAKILQHSSIGGFVSHCGWSSVMESLKFGVPIIAIPMHLDQPLNARLVVDVGVGLEVIRNHGSLEREEIAKLIKEVVLGNGNDGEIVRRKAREMSNHIKKKGEKDMDELVEELMLICKMKPNSCHLS

SEQ ID NO: 289 - protein, 462 aa, Corchorus capsularis
MDAKQKKISVLMFPWLAYGHISPFLELAKKLSKRNFHIFFCSTPINLNTIKPKLSPKYSQSIEFVDFHLQSLPDLPPHYHTTNGLPPHLMNTLKKAFDMSSLHFSKILKTLNPDLLIYDFILPWAPLLALSNKIPAVHFLCTSATVSSFLVHALKKPCEEEFPFPKIYYCFLNAKFNNKMENCSGDDGISDIDRTLQSFERSMKIILVKTFEELEGKFMDYLSVLLNKKIVPTGPLIQDPNEDEGDDDERTKIFLEWLNKKGKSSTVFVSFGSEYFLDKEEREEIAYGLELSKVNFIWVIRFPIGENKTNLDEALPQGFLQRVGERGLVVENWAPQAKILQHSSIGGFVSHCGWSSVMESLKFGVPIIAIPMHLDQPLNARLVVDVGVGLEVRRNHGSLEREEIAKLIKEVVLGNGNDGEIVRRKAREMSNHIKKKGEKDMDELVEELMLICKMKPNSCHLS

SEQ ID NO: 290 - protein, 443 aa, Nicotiana tabacum
MEAKKNTTRVLMVPWLAHGHISPFLELAKKLTNRNFHIYMCSTPVNLSSIKKNVTEKYSQSIELVELHLPSLPNLPPHYHTTNGLPPHLMNTLKTAFEMAAPKFSKILETLNPDLVIYDYNQPWTAQLALSMNIPAVQLLTFSAAVVALGIHMSEDKEEKFPFPEIYLREYEMFSLKKAINESPGKEFPFGEALRRSRDIVLVKTCRDFEGKYMDYLSNLVTKKIVPVGTLVQESTDQAEHEEIMQWLDKKEKSSTVFVSFGSEYFLSNEEILAVAQGLELSKVNFIWVIRFPQGERISIADAVPEVFLERVGERGKILEEWAPQANILQHPSTGGFVSHCGWSSFMESMKFGVPIIAMPMHIDQPMNARLVEYIGLGVEAVRDENGKLQSEEIAKAIRKVVMEESGEPVRKKAIELSEKMNENGEEEIDGVVEELVSLCGNK

SEQ ID NO: 291 - protein, 451 aa, Nicotiana attenuata
MENQEPIRALMFPWLGHGHISPFLELAKKLVTRNFIIYLCSTPANFTSVKQKLINENLTEKIYLVELRLPSLPNLPPHYHTTNGLPPHLMSTLKKAFKMSSPMFTKIVNTIKPDLLLYDLLQPWAPRAALENNIPAVVFVTSSSVMFSHMFHTFRYPSSKFPFPSIYYRDYEITRMLENQDLEPIEQQQKDNTSVKLCFGRSSNVVLIKGFKEIDGKYSSYLSRLTKKKIIPVGPLVQEPTSEDDNSSQILTWLNQKEKGSSVFVSFGSEYFLTKEDREEIAHGLEQSGVNFIWVVRFPKGGKLKLEQALPEGFFKRVGERGMVVEDWAPQAKILGNPNIGGFVSHCGWNSVMEGMKFGVPIIAMPMHLDQPLNARLVEEVGVGLEVVRNKDGKLDREQIAAMINRVVLDMRGEAVREKAKKMSETIRVKGDEEIDVVVQELLKLCKRNVV

SEQ ID NO: 292 - protein, 443 aa, Nicotiana tabacum
MEAKKNTIRLLMVPWLAHGHISPFLELAKKLTNRNFHIYMYSTPVNLSSIKKNVTEKYSQSIELVELHLPSLPNLPPHYHTTNGLPPHLMNTLKTAFEMAAPKFSKILETLNPDLVIYDYNQPWTAQLALSMNIPAVQLLTFSAAVIALGIHMSEDKEEKFPFPEIYLREYEMLSLKKAINESPGKEFPFGEALRRSRNIVLVKTCRDFEGKYMDYLSNLVTKKIVPVGTLVQEATDQDEHEEIMQWLDKKEKSSTVFVSFGSEYFLSNEEILAVAQGLELSKVNFIWVIRFPQGERISIADVVPEVFLERVGKSGKILEEWAPQANILQHPSTGGFVSHCGWSSFMESMKFGVPIIAMPMHIDQPMNARLVEYIGLGVEAVRDENGKLQSEEIAKAIRKVVMEESGEPVRKKARELSEMMNEKGDEEIDGVVEELVSLCGNK

SEQ ID NO: 293 - protein, 459 aa, Nicotiana tabacum
MNGFMDNQKLLRVLMFPWLGYGHISPFLELAKKLSQRNFTIYLCSTPVNLSSIKKKLSPEFSPSIQFLELHLQTLSNLPPCHHTTNGLPPHLMNTLKEAFDLASPDFTLILKTLKPDLLIYDFLQPWAPKAAAELKIPAVEFISSSSTMTSYMLHVFNKPGIKFPFSSIYYRDYEIARIEKDESSMPMEKLEEDKKRVRDCFYLSSDIVLIKSFKEIEGKYSDYVTNSTGKKVVPVGPLVQEPTLDDGESELITWLNEKEEKSTIFVSFGSEYFLSKEDLLEIACGLENSKVNFIWPIRFQKEKDVELQEALPKGFFNRVGNRGKVFKGWAPQAKILEHSSIGGFVSHCGWSSVMESMKYGVPIIAMPMHIDQPINSRLVEEIGIAVEVVRDSNAKLHREVVAAIINQVVVEKEGEFVRQKARDMQEILCSKGDEEIEEVAKELEKLCAKKTHSFIEGF

SEQ ID NO: 294 - protein, 455 aa, Cucumis melo
MDVQKSRDTPTTILMLPWIGYGHLSAYLELAKVLSKRNNFLIYFCSTPVNLDSIKRKVVPSSSSIQFVELHLPSSPEFPPHLHTTNALPPRLTPTLHKAFAAAASPFEEILQTLCPHLLIYDSLQPWAPQIASSLNIPAINFNTTAASIICHALHNINYPDTKFPLSDWVLHNYWKGKYTTADPTNSERIRRVRESFLYCLSASHDVSLINSCREIEGEYMDYLSVLLKKKVIAVGPLAYEPREDEDEEDEDYSRIKNWLDKKEVSSTVLVSFGSEYFPSKQEMEDIGNGLEESGANFIWVIRFPKGEENRRVEEALPEGFVEKAGERAMILKDWAPQGKILKHRSIGGFVSHCGWNSVMESILLGVPVIGVPMHVDQPYNAGLVEEAGLGVEAKRDPDGRIQREEVAKLIREVVVNKNREDLRTKVKEMSEILRSKGDEKIEEMVAQISLLLKI

SEQ ID NO: 295 - protein, 443 aa, Nicotiana sylvestris
MEAKKNTIRLLMVPWLAHGHISPFLELAKKLTNRNFHIYMYSTPVNLSSIKKNVTEKYSQSIELVELHLPSLPNLPPHYHTTNGLPPHLMNTLKTAFEMAAPKFSKILETLNPDLVIYDYNQPWTAQLALSMNIPAVQLLTFSAAVIALGIHMSEDKEEKFPFPEIYLREYEMLSLKKAINESPGKEFPFGEALRRSRNIVLVKTCRDFEGKYMDYLSNLVTKKIVPVGTLVQEATDQDEHEEIMQWLDKKEKSSTVFVSFGSEYFLSNEEILAVAQGLELSKVNFIWVIRFPQGERISIADVVPEVFLERVGKSGKILEEWAPQANILQHPSTGGFVSHCGWSSFMESMKFGVPIIAMPMHIDQPMNARLAEYIGLGVEAVRDENGKLQSEEIAKAIRKVVMEESGEPVRKKARELSEMMNEKGDEEIDGVVEELVSLCGNK

SEQ ID NO: 296 - protein, 445 aa, Nicotiana tabacum
MEGKKNTISILMLPWLAHGHISPFLELAKRLTKRNFHIYMCSSPVNLNSIKKSVTEKYSKSIELVELHLPSLPNLPPYYHTTNGLPPHLMNTLKTAFERSSPNFSKILQTLNPDLVIYDFIQPWAATFASSMNIPAVQFLTFSAAVLAFAFHMFEKRGEDFPFPEIYLRKYEMVQMKKIMEESKDDKSPFDEALRKSRDFILVKTCKEFEGKYMDYFSSLVSKKIVPVGSLVQDSVNEDNNDEITQWLDKKEKSSTVFVSFGSEYFLSKEEIHEVAQGLELSKVNFIWVIRVPQGVKNSTIQDALPKEFLEKVEDRGMVLEKWAPQATILKHKSIGGFVSHCGWSSFMESVKFGVPIIAMPMHIDQPMNAKLVEYVGIGLEAVRDDDNGKLQSKEIAKVIRKVVVEGSGEDVRKKVRELSEKMNAKGDEEIDGVVEELVALCNNK

SEQ ID NO: 297 - protein, 440 aa, Capsicum annuum
METKKNTISVLMLPWLAHGHISPFLELAKKLANRNFHIYLCSTPVNLSSIKKGVAQKYSQSIELVELHLPSLPNLPPHYHTTNGLPPHLMNTLKTAYETVAPSFSKLLQTLNPDLVIYDYNQPWAADSATSVNIPAVQFLTFSAAVIALGIHMYDNPGEMFPFPEIYLSEYERLSLDKALQGGKFPFDEGLRRSQDIILMKTCRDFEGKYMDYLSSLVSKKIVPVGTLVQESTNKDDHEEIMQWLDKKDKRSTVFVSFGSEYFLSKEEIHEVAEGLERGKVNFIWVIRFPQGERISIRDALPEGFLELVGERGMVMEGWAPQATILQHASIGGFMSHCGWSSFTESMKFGVPIIAMPMHIDQPMNARLVEYMDMGVEAVRDENGKLQREEIAKAIRKVVVEESGEVVRKKAKELSEKMNAKGDEEIDGVVEELVALCNNK

SEQ ID NO: 298 - protein, 443 aa, Capsicum annuum
MESKKNTLSVLMLPWLAHGHISPFLELAKKLTNRNFHIYMCSTPINLSSIKKNITKKYSQSIELVEIHLPSLPNLPPQYHTTNGLPPHLMNTLKIAFEMAAPKFSKILRTLNPDLVIYDYNQPWAADSASSMNIPAVQFLTFGAAVVSMAIQISKDTEDKFPFPEIYLHEYEMISLKEAVKESPSDKYSFDEALRLSRDIMLVKTCRHFEGKYIDYLSNLVSKKIVPVGSLVQESIDQDDHAEIMQWLDKKEKNSTVFVSFGSEYFLSNEQIHAVAQGLELSKVNFIWVIRFPLGERINIRDALPEGFLERVGERGTVIEGWAPQATILQHPSIGGFVSHCGWSSFMESMKFGVPVIAMPMHIDQPVNARLVEYIGMGVEAARVEDGKLQNEEIAKVIREVVVEDRGEAVRKKAKQLSDRMNAKGDKEIDGVVEELVALCNNK

SEQ ID NO: 299 - protein, 454 aa, Capsicum annuum
MATQVTVCGSTLRVLMFPFLAHGHITPFLNVAKKLADRGFLIYLCSTPVNLKSIINKIPEKYSESIHLVELHLPELPELPPHYHTTNGLPLHLNHILHKALKMSKPNFTKILQNLKPDLVIYDILQQWTEDVANEQNIPAVKFLTFGAAVISYFSHLIRKSGVEFPFPAIYLRKIEQVKMSEMMAKSAKDKQPDDVDPFADGKAQTMLINTTRTIEAKYIDILSELNSWKVFPVGPPVQDPITSDVDEVELIDWLGTKDENSTVFISFGSEYFLSKEDMEEIAFGLELSNVNFIWVARFPKGEEKNLEDTLPKGFLERIGDRGRVLDKFAPQSRILNHPSTGGFISHCGWNSVMESIDFGVPIIAMPIHLDQPMNARLVVELGVAVEIVRDDDGKIHRGEIAGTLKDVITGKTGENLRAKARDISKNLKSVKGEEMDVVTEELIRFCKNSTKLN

SEQ ID NO: 300 - protein, 454 aa, Capsicum annuum
MATQVTVCGSTLRVLMFPFLAHGHITPFLNVAKKLADRGFLIYLCSTPVNLKSIINKIPEKYSESIHLVELHLPELPELPPHYHTTNGLPLHLNHILHKALKMSKPNFTKILQNLKPDLVIYDILQQWTEDVANEQNIPAVKFLTFGAAVISYFSHLIRKSGVEFPFPAIYLRKIEQVKMSEMMAKSAKDKQPDDVDPFADGKAQTMLINTTRTIEAKYIDILSELNSWKVFPVGPPVQDPITSDVDEVELIDWLGTKDENSTVFISFGSEYFLSKEDMEEIAFGLELSNVNFIWVARFPKGEEKNLEDTLPKGFLERIGDRGRVLDKFAPQSRILNHPSTGGFISHCGWNSVMESIDFGVPIIAMPIHLDQPMNARLVVELGVAVEIVRDDDGKIHRGEIARTLKDVITEKMGENLRAKARDISKNLKFVKGEEIDVVTEELIRFCKNSTKLN

SEQ ID NO: 301 - protein, 455 aa, Capsicum annuum
MATEVTKYPSTLKVLMFPWLAYGHISPFLNLAKKLADRGFLIYFCSTPINIKSIIKKIPEKYCDSIELVELHLQELPELPPHYHTTNGLPPHLNHTLQKAMKMFKPNFVKILQNLKPDLVIYDIVQQWAERAANEQNIPTVKLIPSGAVAVTYFFNLANKLGVDYPFSAIYLRKIEQVKMSETFAKHAEGKEDDDVDPFANGNMQIVLVSTSRILEAKYIDYCTELMNWRAVPVGPPVQDPMYNDDADEVELIDWLGKKGENSTVFVSFGTEYFLSREDREEIAFGLELSNVNFIWVVRYPNGEEQNLEDVLPKGFLERIGDRGRVLNKFAPQSRILNHPTTGGFVSHCGWNSVMESIDFGVPIIAMPVHLDQPMNARLMVELQVAVEIVRDDDDKIHRGEIAETLKGVVTGKIGENLRAKIRDISENLKSTRGEEMDAAANELIQLCKNSNKCK

SEQ ID NO: 302 - protein, 446 aa, Capsicum annuum
MGTLRVLMFPFLAYGHISPYLNVAKKLADRGFLIYFCSTAINLKYTIKKIPEKYSDSIQLVELHLPELPELPPHYHTTNGLPPHLNHTLQKALKMSKPNFAKILRSLKPDLVIYDVLQQWAQSVANDQNIPAVKMLTSGAAVISYFFNLRKKPGVEFPYPAIYLTKIEQVKVAELLAKADKEKEPDDVDPFADGNMQIMLMSTSRVLEAKYIDFFTELGHWKVVPVGPPVQDPIIDEVDDVELIDWLGMKDESSTVFVSFGSEYFLSKEDMEEIAFGLENSNVNFIWVARFPKGEEQNLEDVLPKGFLERIGDRGRVLNKFAPQPRILNHPSTGGFISHCGWNSIMESMDFGVPIIAIPMHLDQPMNARLMVELGVAIEIVRDDDGKFHRGEIAETLKDVITRKRGEILRAKVRDISKNLKSVRDEEADVVAKELIQLCKDSNKCN

SEQ ID NO: 303 - protein, 435 aa, Manihot esculenta
MFPWLAHGHLSPFLELSKKLANRNFHVYFCSTPVNLDSIKPKLSPEYHFSIQFVELHLPSSPELPSHYHTTNGLPPHLMKTLKKAFDMASSSFFNILKTLNPDLLIYDFLQPWAPALASSLNIPAVNFLCSSMAMSCFGLNLNKNKEIKFLFPEIYPRDYMEMKLFRVFESSSNQIKDGERAGRCIDQSFHVILAKTFRELEGKYIDYVSVKCNKKIVPVGPLVEDTIHEDDEKTMDHHHHHHDEVIKWLEKKERSTTVFVSFGSEYFLSKEEMEEIAHGLELSKVNFIWVVRFPKGEKINLEESLPEGYLERIQERGKIVEGWAPQRKILGHSSIGGFVSHCGWSSIMESMKLGVPIIAMPMNLDQPINSRIVEAAGVGIEVSRNQSGELEREEMAKTIRKVVVEREGVYKGEEEIDGVVDELVQLCDMKTNYL

SEQ ID NO: 304 - protein, 446 aa, Gardenia jasminoides
MKVLMLPWLAHGHISPFLELAKRLAKKNFHIYLCSTSVNLSSIKNKITGEYSDSIEPVELQLPCLPDLPPHYHTTNGLPPHLMTTLKTAYELSAPDFSNILTALHPDLVVYDFNQPWAAEIASSKNIPAVQFLPVGATMMAFSLHMLKYSGKEFPHPEIYIRDYEMLKFQSRNDQVNDVSDRERILQALDLSCKILLVKSFKEIEEKFMNTLSVASGKKVVPVGPLVQDVNIDDIQDEEMEIIHWLDQKENASVVFVSFGSEYFLTKEERNEIARGLELSNVNFIWVIRFPLGGKITMEEALPEGFLERVGDRGKIVDGWAPQARILKHANTGAFLSHCGWSSMMESMKFGVPIIAMPMSVDQPVNARLIEAVGVGLEPLRDEKGNLQSAEIAKVIRKVLVDESGENVRRKAKELSEQMEMRGDEEEIDNLVEELLQLCRKNNGGC

SEQ ID NO: 305 - protein, 470 aa, Macleaya cordata
MDYKEEDHHNRFRVLMFPWLAHGHISPFLELAIKLTQRNFYIYFCSTPINLSSIKQQLTHHHETTTILFNPSLIQLIDLHLPSLPNLPPHYHTTKSLPPHLMSTLKKALDLSTPSFSNLLSTINPDLLIYDFIQPWAPTAASRLNIPAIQFLSTGAAFFSFFLHLLENPAVKFPFPSIYLTDYEERRVSQIMSYSDGLKDRDRLIQSINRSSNIVLIKTFREIEGNYIDYLSSSVGKEFVPVGPLVHEPPDFDNQMKKFSEWLVKKEKSSVVFVSFGSEYFMSKEEVEEIAYGLELSKVNFIWVIRFPEEEDNMRKISLHEVLPEGFMERVGVKGMVVEGWAPQAKILVNCKIGGFVSHCGWSSVMESMKFGVPVIAMPMHLDQPLNARLVVELGLGVEVQRGGDGGCRFEREEVAKVIKEVVMEKEGEEVRRRAREISEKMREKGEEEIDVLVEKLEQLCKKKKEHYLV

SEQ ID NO: 306 - protein, 451 aa, Juglans regia
MDGRHSRISVLMFPWLAHGHISPFLELAKKLTKRNFHIYFCSTPVNLRPIKEKLPEKYSLSIQLVELHLPSLPELPPHYHTTNGLPPHLMPTLKKAFDMASPNFSTIVKNLRPDLLIYDFLQQWAPSIALSRNIPAVEFLPTNAAMTSFVIHLTKNPGVEFPFPEIYLRDNYAISKFQNVLESSANGIKDTERAVECCEQSSEIVLIKTFREIEAKYLDYLSELTGKKIVPVGPLVQDPVHEYDEKPGIMEWLNNKERSSTVFVSFGSEYFLSKEEMEEIAYGLEQSMVPFIWVVRFPGGAKVSLEMALPKGFLDRVGDGGMVVEGWAPQTKILEHSSIGGFSSHCGWSSVLESMKLGVPIIAMPMHLDQPINARLVEEVGMGLEVERDMNGKLKREEVAKVIREVVVEKAGESVRQKAKELKEKLISKGEEEIDEVVQEVVQLCRKKNRH

SEQ ID NO: 307 - protein, 446 aa, Dendrobium catenatum
MEEEASKLHIVMLPWLAMGHLLPFFELSKRLALKGVEISFFSTPSNIHRLPSIPQSITPNINFISCSINNITSNIENTVDLRSEAARPLLIQAYATFESHLTAFLSDASRPKPDWIIYDFAAASWAPALASRFKVNSAFFCLFNAAAVAFFIHAKDYDSPEKLSTVPDSIPFPTTVAFRPFEARHVYSMLSQKSNQTEPKTQSIQFTLIRTCKEFESKWVDLLGDIYAPVGLLPPSFDKEEESETWTRICEWLDEQKESSVIYVAFGSEAILTTEQIDEIALGLEKSGLPFFWVLRVGSPPQGFEERTAGRGLVWMGWAPQARLLAHRTVGGFLTHGGWNSVVEGLVVGAPMVVLPMVFEQGLNARHLVESGYAVEVARNDEDGSFSGEEIARKLRMVMVEEEGEELRKKARMGKEVFGSEKLQEEYLDELAKKLWEKRKVVAEPV

SEQ ID NO: 308 - protein, 444 aa, Nicotiana attenuata
MVAKKNTISILMLPWLAHGHISPFLELAKRLTKKNFHIYMCSTPVNLNSIKKTVTEKYSQSIELVELHLPSLPNLPPYYHTTNGLPPHLMNTLKIAFEMSSPNFSKILQTLNPDLVIYDFIQPWAATFASSMNIPAVQFLTFSAGVLAFAFHMFEKPGEDFPFPEIYLREYEMLQMKKIMEESKDGNSQFDEALRKSLDFILVKTCKEFEGKYMNYFSSLVSKKIVPVGSLIQDTVSGDDNEEITQWLDKKEKNSGVFVSFGSEYFLSKEEIHEVARGLELSKVNFIWVIRFPQGEKNSSIKDALPKGFLERVEDRGMVLEGWAPQAAILKHKSIGGFVSHCGWSSFMESVKFGVPIIAMPMHLDQPMNARLVEYIGFGVEAVRDDNGKLQSEEIAKVIRKVVMEESGEDVRKKVRELCEKMNTEGNEEIDGVVEELVALCNNK

SEQ ID NO: 309 - protein, 458 aa, Nicotiana attenuata
MDASMEIINQKPVRILMFPWLGHGHISPFLELAKKLITRNFTIFLCSTPGNFISIKQKLINENLTEKIHLVELRLPSLSDLPRHYHTTNGLPPHLMSTLKKAFAKSRPIFSQILNTVEPDLLLYDLLQPWAPKLALEKNIPAVVFVTSSATMFSYMFHTFRYPNMEFPFSSSIYYRDYELTRMLKNQDLEPIEQQQKDKTSVKLCFKRSFDIVLIKGFKEIDGKYCDYISSLTKKKIIPVGPLVQETTSEDGNSQILTWLNQKEKGSTVFVSFGSEYFLSQEDREEIAHGLEQSRVNFIWVLRFPKGEKLKLEQALPQGFFKKVGERGMVVEDWAPQVKILGNPNIGGFVSHCGWNSVMESMKLGVPIIAMPMHLDQPLNARLVEEVGVGLEVVRDKHGKLDSEKIAQVINFVVLEQRGESIRAKARKMSETIRVKGDEEIDEVVQELLKLCKRSNVV

SEQ ID NO: 310 - protein, 451 aa, Prunus yedoensis
MVCSERRTLTILMLPWLAHGHISPFLELAKKLTSKRNFHIFICSTPVNLTSIKPKLSPKYSHCIEFVELHLPHDDLPELPPHYHTTNGLPPHLMSTLKRAFDMSSNNFSTILTAVKPDLLIYDFLQPWAPTLASLQNIPSVEFITTSAALTSFSVHHLRNPSDKFPFPLIYLQDYEAKKFNNILESSSNGIKDGDRILQCSELSSGIILVKTSREIEAKYVDYLSGLMGKKIVPVGPLVQEPMDLKVDEETWITKWLNKRKRSSVVYVCFGSEYFLSREQIEELAHGLELSKVSFIWVIRFPKEEKGNRVEEVLPEGFLERVGEKGVIVEGWAPQAKILKHSSVGGFVSHCGWSSVLESIKFGVPIIAMPMHLDQPINSRLVEEVGVGVEVKRTAEGSLERKEVAKVIRDVMAKKIGEGVRKKALEIRDNMKKKEDEEINGVVEELMQLCT

SEQ ID NO: 311 - protein, 450 aa, Actinidia chinensis
MDTRERGTIKVLMLPWLGHGHVSPFLELAKKLTSRKFVIYLCSTPINLSSIKKRVTENDSLSLELVELHLPTLPELPPHHQTTNGLPLHLHPTLKQAFDMSSSSFSNILQTLRPDLVIYDILYPRAAPTVASSYNIPVVQLIPTAAALISYGLHVFQKHGVEFPFAAIQPRGPRRAPPREAPVDDDTKERFLGGIRQSCKMILLNTFRELEGKYIDYLSTLTDKKIVPVGPLVQDTNIVEQNDSQIMQWLGTKDEFSTVFVSFGSEYFLSKEEMEEVAHGLELSKLNFIWVVRFPFVEKIELQEALPKGFLDRLGNRGLVVEDWAPQAQILAHSSTSGFVSHCGWNSILESLKFGVPIIAIPMKYDQPMNGRLVEDVGVAVEVKRDENGKLNREEIAQVIRKVVGEKDGEDVRIKAREFSEGMRMKGEEEIDGLVEELVQLCNEAKLLKN

SEQ ID NO: 312 - protein, 449 aa, Vitis vinifera
MNSRRQSRIKVLVLPWLAHGHISPFLELSKQLMKQKFYIYFCSSPVNLSRIKGKLTGNYSHSIQLVELHLPSLPELPPHYHTTNGLPPHLMPTLKMALDMASPSFTNILKTLSPDLLIYDFIQPWAPAAAASLGIPSVQFLSNGAAATAFMIHFVKKPGNEFPFPEIYLRDYETSGFNRFVESSANARKDKEKARQCLEQSSNVILIRSFKEIEERFIDFLSNLNAKTVVPVGPLLQDQLDEEDAETEMVEWLSKKDPASSVFVSFGSEYFLSKEELEEVAYGLELSKVNFIWVVRFPMGDKTRVEEALPEGFLSRVGDKGMVVEGWAPQKKILRHSSIGGFVSHCGWGSVMESMNFGVPIVAMPMHLDQPFNAKLVEAHGVGIEVKRDENGKLQREEIAKVIKEVVVKKCGEIVRQKAREFSENMSKKGDEEIVGVVEKLVQLCGKRN

SEQ ID NO: 313 - protein, 454 aa, Catharanthus roseus
MATEQQQASISCKILMFPWLAFGHISSFLQLAKKLSDRGFYFYICSTPINLDSIKNKINQNYSSSIQLVDLHLPNSPQLPPSLHTTNGLPPHLMSTLKNALIDANPDLCKIIASIKPDLIIYDLHQPWTEALASRHNIPAVSFSTMNAVSFAYVMHMFMNPGIEFPFKAIHLSDFEQARFLEQLESAKNDASAKDPELQGSKGFFNSTFIVRSSREIEGKYVDYLSEILKSKVIPVCPVISLNNNDQGQGNKDEDEIIQWLDKKSHRSSVFVSFGSEYFLNMQEIEEIAIGLELSNVNFIWVLRFPKGEDTKIEEVLPEGFLDRVKTKGRIVHGWAPQARILGHPSIGGFVSHCGWNSVMESIQIGVPIIAMPMNLDQPFNARLVVEIGVGIEVGRDENGKLKRERIGEVIKEVAIGKKGEKLRKTAKDLGQKLRDREKQDFDELAATLKQLCV

SEQ ID NO: 314 - protein, 451 aa, Prunus persica
MVYSERRTLTILMLPWLAHGHISPFLELAKKLTSKRNFHIFICSTPVNLTSIKPKLSPKYSHCIEFVELHLPHDDLPELPPQYHTTNGLPPHLMSTLKRAFDMSSNNFSTILTALKPDLLIYDFLQPWAPSLASLQNIPSVEFITTSAALTSFSVHHLRNPIDKFPFPSIYLRDYEAKKFNNLLESSSNGIKDGDRVLQCSDLSSGIILVKTSREIEAKYVDYLSGLMGKKIVPVGPLVQEPMDLKVDEETWIMKWLNKRERSSVVYVCFGSEYFLSREQIEELAHGLELSKVSFIWVIRFPKEEKGNRVEEVLPEAFLERVGEKGVIVEGWAPQAKILNHSSVGGFVSHCGWSSVLESIKFGVPIIAMPMHLDQPINSRLVEEVGVGVEVKRTAEGSLERKEVAKAIRDVVAKKIGEGVRKKALEIRDNMKNKEDEEINGVVEELMQLCT

SEQ ID NO: 315 - protein, 447 aa, Genlisea aurea
MESDVLRIVVLPWLAMGHLRPFLRLAKSFARKGHRVSLISTTGNIRRLPKVPEELSELVDLVGFPLPEIRDLPPGCESSMDTPPQKQYLLRTALDSLHDPTRKYLEEEKPDWIVYDYSFSWVPKMAAELGISGAYFCVYPACFLTFVGQGKGHAEYKLEDLVNVPKWIPFPSNMAFRPHELMRNKEMQHATESDVERFNLVKESSSIFLLRSSPEIESEWIELLAKQYDKPVFPTGFLSVADEENETPADDRWIQITDWLDAQPPSSVVYVSFGSEVVLTRKEVHEISIGLERSGSPFLWALLDRSDQLELLPEGFLQNVGDRGRVYSGWAPQVAILSHPSVGGFLTHCGWNSVTEALGCGRVLILFPVMNDQGLIARLMDSKGLGIEIPRDHMDGSFSGDDVAETVRFAMVEEGGGKLRENARKMKELLEDKEKSQHYVDKALEYM

SEQ ID NO: 316 - protein, 449 aa, Solanum tuberosum
MEAKKNTISILMLPWLAHGHISPFLELAKKLTNRNFHIYLCSTPINLSSIKKNVTKKYCESIELVELHLPSLPNLPPHYHTTNGLPPHLMNTLKKAFENASPNFSKILQTLNPDLVIYDFNQPWAAEFASSMNIPAIQFLTFSAAIVALLALHIMFDKSGEKFPFPEIYLREHEMLQIKKSLEESKDENYKDPFNDALRLSRDIVLVKTSRDFEGKYIDYLSKLVSKKIVPVGSLVQDSIDQDHDHEEIIMQWLDKKEKCSSVFVSFGSEYFLSKEEMHEVAQGLEFSKVNFIWVIRFPQGEKNSIQDVLPQGFLERVGERGMVLEKWAPQAAILQHRSTGGFVSHCGWSSVMESMKFGVPIIAMPMHIDQPMNARIVEYIGMGVEALRDENGKLQSEEIAKVMREVVIEESGEGVRKKTKELSEKMNMKGDEEIDGVVEELVALCNNK

SEQ ID NO: 317 - DNA, 1362 bp, Artificial Sequence
  Synthetic Polynucleotide
atgaaccaagatggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagatagacgcgcaacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccataa

SEQ ID NO: 318 - DNA, 1371 bp, Artificial Sequence
  Synthetic Polynucleotide
atgggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagataggttctggagacgcgcaacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaagattaa

SEQ ID NO: 319 - DNA, 1353 bp, Artificial Sequence
  Synthetic Polynucleotide
atgaaccaagatggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagatacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccataa

SEQ ID NO: 320 - DNA, 1362 bp, Artificial Sequence
  Synthetic Polynucleotide
atggatggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagataggttctggacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaataa

SEQ ID NO: 321 - DNA, 1362 bp, Artificial Sequence
  Synthetic Polynucleotide
atggacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagataggttctggacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaagatggcgaataa

SEQ ID NO: 322 - DNA, 1362 bp, Artificial Sequence
  Synthetic Polynucleotide
atggacgcgcaacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttatcaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaagatggcgaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagatataa

SEQ ID NO: 323 - protein, 453 aa, Artificial Sequence
  Synthetic Polypeptide
MNQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEP

SEQ ID NO: 324 - protein, 456 aa, Artificial Sequence
  Synthetic Polypeptide
MGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIGSGDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQD

SEQ ID NO: 325 - protein, 450 aa, Artificial Sequence
  Synthetic Polypeptide
MNQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEP

SEQ ID NO: 326 - protein, 453 aa, Artificial Sequence
  Synthetic Polypeptide
MDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIGSGRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQ

SEQ ID NO: 327 - protein, 453 aa, Artificial Sequence
  Synthetic Polypeptide
MDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIGSGRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDGE

SEQ ID NO: 328 - protein, 453 aa, Artificial Sequence
  Synthetic Polypeptide
MDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFITTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKI

SEQ ID NO: 329 - DNA, 1362 bp, Artificial Sequence
  Synthetic Polynucleotide
atggaagacgaaggttatagttcgataaagaattggctcgataaaaaggagccctcctcaactgtctttgtttccttcgggtccgaatattttccgtccaaagaagaaatggaagaaattgcccatggcttggaggctagcgaggtacactttatttgggtcgttagattcccacaaggagacaatacttctgcaattgaagatgcccttcctaagggttttcttgagcgagtgggcgaacgtggaatggtggttaagggttgggctcctcaggccaaaattttgaaacattggagcacaggcggtttcgtaagtcattgtggatggaatagtgttatggagagcatgatgtttggtgtacccataataggtgttccgatgcatttagatcaaccatttaatgcagggctcgcggaagaagcaggagtaggggtagaggctaaaagggaccctgatggtaagatacagagagatgaagtcgctaaactgatcaaagaagtggttgtcgaaaaaacgcgcgaagatgtcagaaagaaggctagggaaatgtctgaaattttacgttcgaaaggtgaggaaaagatggacgagatggttgcagccattagtctcttcttgaagatagacgcgcaacgcggacatacgactaccatcctgatgtttccgtggttggggtacggccaccttagtgcattcctcgaattagccaagagcttgtcgcgtaggaactttcatatttatttctgttccacatctgtcaatttagatgctataaaacccaaactaccatcatcttcaagttccgattctattcagcttgtagagttatgcttgccttcctcgccagaccaactacccccacacctgcatacaactaatgctctacctccacatctaatgcctaccctgcaccaggccttttcaatggcagctcaacattttgcagctatattacatactttagcaccgcacttgttaatctatgattcgttccagccttgggcgccacaattggccagctctcttaacattcctgctattaattttgttaccacgggtgccagtgtgctaacaagaatgttacacgcgactcattacccatcttcaaagttcccaatctccgaatttgttttacatgattattggaaagcaatgtattcagcagctggtggtgctgttacaaaaaaggaccataaaataggagaaaccttggcaaactgtttacacgcttcttgctcggtaattctgatcaattcattcagagagttggaagaaaaatacatggattacttgtctgtcttactaaacaagaaagttgtgcccgtgggtccgcttgtttatgagccaaaccaagatggctaa

SEQ ID NO: 330 - protein, 453 aa, Artificial Sequence
  Synthetic Polypeptide
MEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKIDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFVTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDG

SEQ ID NO: 331 - protein, 10 aa, Artificial Sequence
  Synthetic Polypeptide
  MISC_FEATURE (2)..(2): Xaa can be Asn or His
GXWASDLGGP

SEQ ID NO: 332 - protein, 5 aa, Artificial Sequence
  Synthetic Polypeptide
  MISC_FEATURE (2)..(2): Xaa can be His or Gln
DXGWL

SEQ ID NO: 333 - protein, 11 aa, Artificial Sequence
  Synthetic Polypeptide
CWGVCFTYAGW

SEQ ID NO: 334 - protein, 10 aa, Artificial Sequence
  Synthetic Polypeptide
GHWASDLGGP

SEQ ID NO: 335 - protein, 5 aa, Artificial Sequence
  Synthetic Polypeptide
DQGWL

SEQ ID NO: 336 - protein, 10 aa, Artificial Sequence
  Synthetic Polypeptide
GHWANDLGGP

SEQ ID NO: 337 - protein, 11 aa, Artificial Sequence
  Synthetic Polypeptide
CWGVCYTYAGW

What is claimed is:

1. A host cell that comprises a heterologous polynucleotide encoding a cucurbitadienol synthase (CDS) enzyme, wherein the heterologous polynucleotide sequence is at least 90% identical to SEQ ID NO: 3 and/or the amino acid sequence of the CDS encoded by the heterologous polynucleotide is at least 90% identical to SEQ ID NO: 43, and wherein the host cell produces 11-hydroxycucurbitadienol, 24-25 epoxy-cucurbitadienol or cucurbitadienol, and wherein the host cell is not a plant cell.

2. The host cell of claim 1, wherein the CDS comprises a leucine at the amino acid residue corresponding to the amino acid residue at position 123 of SEQ ID NO: 73.

3. The host cell of claim 1, wherein the host cell further comprises one or more heterologous polynucleotides encoding a UDP-glycosyltransferase (UGT), a C11 hydroxylase, a cytochrome P450 reductase, an epoxide hydrolase (EPH), a lanosterol synthase, and/or a squalene epoxidase.

4. A method of producing 11-hydroxycucurbitadienol, 24-25 epoxy-cucurbitadienol or cucurbitadienol, comprising contacting the host cell of claim 1 with 2-3-oxidosqualene or 2,3; 22,23-diepoxysqualene, thereby producing the 11-hydroxycucurbitadienol, 24-25 epoxy-cucurbitadienol or cucurbitadienol.

5. The method of claim 4, wherein the method further comprises isolating the 11-hydroxycucurbitadienol, 24-25 epoxy-cucurbitadienol or cucurbitadienol.

6. The host cell of claim 1, wherein the host cell is a yeast cell or a bacterial cell.

7. The host cell of claim 6, wherein the host cell is a *Saccharomyces* cell or a *Yarrowia* cell.

8. The host cell of claim 6, wherein the host cell is an *E. coli* cell.

9. The host cell of claim 1, wherein the host cell produces at least 10%, 20%, or 30% more 11-hydroxycucurbitadienol, 24-25 epoxy-cucurbitadienol or cucurbitadienol relative to a control, wherein the control is a host cell that expresses *S. grosvenorii* CDS, encoded by a polynucleotide corresponding to SEQ ID NO: 33.

10. The host cell of claim 1, wherein the CDS comprises the motif DQGWL (SEQ ID NO: 335).

11. The host cell of claim 10, wherein the motif DQGWL (SEQ ID NO: 335) is located at residues in the CDS corresponding to residues 479-483 in SEQ ID NO: 73.

12. The host cell of claim 1, wherein the CDS comprises the motif GHWANDLGGP (SEQ ID NO: 336).

13. The host cell of claim 12, wherein the motif GHWANDLGGP (SEQ ID NO: 336) is located at residues in the CDS corresponding to residues 117-126 in SEQ ID NO: 73.

14. The host cell of claim 1, wherein the CDS comprises the motif CWGVCYTYAGW (SEQ ID NO: 337).

15. The host cell of claim 14, wherein the motif CWGVCYTYAGW (SEQ ID NO: 337) is located at residues in the CDS corresponding to residues 612-622 in SEQ ID NO: 73.

16. The host cell of claim 1, wherein the amino acid sequence of the CDS comprises SEQ ID NO: 43.

17. The host cell of claim 7, wherein the host cell is a *Saccharomyces cerevisiae* cell.

18. The host cell of claim 7, wherein the host cell is a *Yarrowia lipolytica* cell.

19. The host cell of claim 1, wherein the host cell is further modified to downregulate ERG7.

* * * * *